US011427813B2

(12) United States Patent
Hallows et al.

(10) Patent No.: US 11,427,813 B2
(45) Date of Patent: Aug. 30, 2022

(54) HUMAN ALPHA-GALACTOSIDASE VARIANTS

(71) Applicant: Codexis, Inc., Redwood City, CA (US)

(72) Inventors: William Casey Hallows, San Francisco, CA (US); Kristen Jean Vallieu, Union City, CA (US); Nikki Dellas, Mountain View, CA (US); Yu Zhu, Newark, CA (US); Judy Victoria Antonio Viduya, South San Francisco, CA (US); Chinping Chng, Menlo Park, CA (US); Antoinette Sero, Foster City, CA (US); Gjalt W. Huisman, Redwood City, CA (US); Rachel Cathleen Botham, Burlingame, CA (US); Moulay Hicham Alaoui Ismaili, San Mateo, CA (US)

(73) Assignee: Codexis, Inc., Redwood City, CA (US)

( * ) Notice: Subject to any disclaimer, the term of this patent is extended or adjusted under 35 U.S.C. 154(b) by 64 days.

(21) Appl. No.: 16/721,102

(22) Filed: Dec. 19, 2019

(65) Prior Publication Data

US 2020/0199563 A1 Jun. 25, 2020

Related U.S. Application Data

(60) Provisional application No. 62/782,553, filed on Dec. 20, 2018.

(51) Int. Cl.
| | | |
|---|---|---|
| *C12N 9/40* | (2006.01) | |
| *A61K 38/47* | (2006.01) | |
| *C12N 15/52* | (2006.01) | |
| *C12N 15/85* | (2006.01) | |
| *A61K 38/00* | (2006.01) | |

(52) U.S. Cl.
CPC .......... *C12N 9/2465* (2013.01); *C12N 15/52* (2013.01); *C12N 15/85* (2013.01); *A61K 38/00* (2013.01); *C12N 2015/8518* (2013.01); *C12Y 302/01022* (2013.01)

(58) Field of Classification Search
None
See application file for complete search history.

(56) References Cited

U.S. PATENT DOCUMENTS

| | | |
|---|---|---|
| 5,356,804 A | 10/1994 | Desnick et al. |
| 5,605,793 A | 2/1997 | Stemmer |
| 5,811,238 A | 9/1998 | Stemmer et al. |
| 5,830,721 A | 11/1998 | Stemmer et al. |
| 5,834,252 A | 11/1998 | Stemmer et al. |
| 5,837,458 A | 11/1998 | Minshull et al. |
| 5,928,905 A | 7/1999 | Stemmer et al. |
| 6,096,548 A | 8/2000 | Stemmer |
| 6,117,679 A | 9/2000 | Stemmer |
| 6,132,970 A | 10/2000 | Stemmer |
| 6,165,793 A | 12/2000 | Stemmer |
| 6,180,406 B1 | 1/2001 | Stemmer |
| 6,251,674 B1 | 6/2001 | Tobin et al. |
| 6,277,638 B1 | 8/2001 | Stemmer |
| 6,287,861 B1 | 9/2001 | Stemmer et al. |
| 6,287,862 B1 | 9/2001 | delCardayre et al. |
| 6,291,242 B1 | 9/2001 | Stemmer |
| 6,297,053 B1 | 10/2001 | Stemmer |
| 6,303,344 B1 | 10/2001 | Patten et al. |
| 6,309,883 B1 | 10/2001 | Minshull et al. |
| 6,319,713 B1 | 11/2001 | Patten et al. |
| 6,319,714 B1 | 11/2001 | Crameri et al. |
| 6,323,030 B1 | 11/2001 | Stemmer |
| 6,326,204 B1 | 12/2001 | delCardayre et al. |
| 6,335,160 B1 | 1/2002 | Patten et al. |
| 6,335,198 B1 | 1/2002 | delCardayre et al. |
| 6,344,356 B1 | 2/2002 | Stemmer |
| 6,352,859 B1 | 3/2002 | delCardayre et al. |
| 6,355,484 B1 | 3/2002 | Patten et al. |
| 6,358,740 B1 | 3/2002 | Patten et al. |
| 6,358,742 B1 | 3/2002 | Stemmer |
| 6,365,377 B1 | 4/2002 | Patten et al. |
| 6,365,408 B1 | 4/2002 | Stemmer |
| 6,368,861 B1 | 4/2002 | Crameri et al. |
| 6,372,497 B1 | 4/2002 | Stemmer |
| 6,376,246 B1 | 4/2002 | Crameri et al. |

(Continued)

FOREIGN PATENT DOCUMENTS

| | | |
|---|---|---|
| JP | 2001-504324 A | 4/2001 |
| JP | 2013520986 A | 6/2013 |

(Continued)

OTHER PUBLICATIONS

UniProt Database Accession No. F7BKN6, Aug. 2017, 2 pages (Year: 2017).*
UniProt Database Accession No. A0A6P6IS94, Jun. 2021, 2 pages (Year: 2021).*
UniProt Database Accession No. A0A6P5ICW3, Jun. 2021, 1 page (Year: 2021).*
Yoshimitsu et al., Mol. Biol. Rep. 38:3145-3152, 2011 (Year: 2011).*
UniProt Database Accession No. D5FGE4, Aug. 2017, 2 pages (Year: 2017).*
Altschul, S., et al., "Basic local alignment search tool," J. Mol. Biol., 215: 403-410 [1990].

(Continued)

*Primary Examiner* — David Steadman
(74) *Attorney, Agent, or Firm* — Codexis, Inc.

(57) ABSTRACT

The present invention provides engineered human alpha-galactosidase polypeptides and compositions thereof. The engineered human alpha-galactosidase polypeptides have been optimized to provide improved thermostability, serum stability, improved cellular uptake, stability under both acidic (pH<4) and basic (pH>7) conditions, reduced immunogenicity, and improved globotriaosylceramide removal from cells. The invention also relates to the use of the compositions comprising the engineered human alpha-galactosidase polypeptides for therapeutic purposes.

25 Claims, 3 Drawing Sheets

Specification includes a Sequence Listing.

(56) References Cited

U.S. PATENT DOCUMENTS

| | | |
|---|---|---|
| 6,379,964 B1 | 4/2002 | delCardayre et al. |
| 6,387,702 B1 | 5/2002 | Stemmer |
| 6,391,552 B2 | 5/2002 | Stemmer |
| 6,391,640 B1 | 5/2002 | Minshull et al. |
| 6,395,547 B1 | 5/2002 | Stemmer |
| 6,406,855 B1 | 6/2002 | Patten et al. |
| 6,406,910 B1 | 6/2002 | Patten et al. |
| 6,413,745 B1 | 7/2002 | Patten et al. |
| 6,413,774 B1 | 7/2002 | Stemmer |
| 6,420,175 B1 | 7/2002 | Stemmer |
| 6,423,542 B1 | 7/2002 | Crameri et al. |
| 6,426,224 B1 | 7/2002 | Crameri et al. |
| 6,436,675 B1 | 8/2002 | Welch et al. |
| 6,444,468 B1 | 9/2002 | Stemmer et al. |
| 6,455,253 B1 | 9/2002 | Patten et al. |
| 6,479,652 B1 | 11/2002 | Crameri et al. |
| 6,482,647 B1 | 11/2002 | Stemmer |
| 6,489,146 B2 | 12/2002 | Stemmer et al. |
| 6,506,602 B1 | 1/2003 | Stemmer |
| 6,506,603 B1 | 1/2003 | Stemmer |
| 6,519,065 B1 | 2/2003 | Colbourne et al. |
| 6,521,453 B1 | 2/2003 | Crameri et al. |
| 6,528,311 B1 | 3/2003 | delCardayre et al. |
| 6,537,746 B2 | 3/2003 | Arnold et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,602,986 B1 | 8/2003 | Stemmer et al. |
| 6,613,514 B2 | 9/2003 | Patten et al. |
| 6,653,072 B1 | 11/2003 | Patten et al. |
| 6,716,631 B1 | 4/2004 | delCardayre et al. |
| 6,946,296 B2 | 9/2005 | Patten et al. |
| 6,961,664 B2 | 11/2005 | Selfinov et al. |
| 6,995,017 B1 | 2/2006 | Stemmer |
| 7,024,312 B1 | 4/2006 | Selfinov et al. |
| 7,058,515 B1 | 6/2006 | Selfinov et al. |
| 7,105,297 B2 | 9/2006 | Minshull et al. |
| 7,148,054 B2 | 12/2006 | delCardayre et al. |
| 7,288,375 B2 | 10/2007 | Stemmer et al. |
| 7,421,347 B2 | 9/2008 | Selfinov et al. |
| 7,430,477 B2 | 9/2008 | Selfinov et al. |
| 7,531,341 B1 | 5/2009 | Vellard et al. |
| 7,534,564 B2 | 5/2009 | Patten et al. |
| 7,534,595 B2 | 5/2009 | Vellard et al. |
| 7,560,263 B2 | 7/2009 | Kakkis et al. |
| 7,620,500 B2 | 11/2009 | Mundorff et al. |
| 7,620,502 B2 | 11/2009 | Selfinov et al. |
| 7,629,170 B2 | 12/2009 | delCardayre et al. |
| 7,702,464 B1 | 4/2010 | Emig et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,776,598 B2 | 8/2010 | Patten et al. |
| 7,783,428 B2 | 8/2010 | Gustafsson et al. |
| 7,795,030 B2 | 9/2010 | Minshull et al. |
| 7,833,742 B2 | 11/2010 | Treco et al. |
| 7,853,410 B2 | 12/2010 | Selfinov et al. |
| 7,868,138 B2 | 1/2011 | Stemmer et al. |
| 7,873,499 B2 | 1/2011 | Selfinov et al. |
| 7,904,249 B2 | 3/2011 | Selfinov et al. |
| 7,957,912 B2 | 6/2011 | Selfinov et al. |
| 8,383,346 B2 | 2/2013 | Colbeck et al. |
| 8,504,498 B2 | 8/2013 | Fox |
| 8,768,871 B2 | 7/2014 | Fox |
| 8,849,575 B2 | 9/2014 | Gustafsson et al. |
| 8,876,066 B1 | 11/2014 | Richards |
| 9,308,281 B2 | 4/2016 | Guild et al. |
| 9,593,326 B2 | 3/2017 | Clark et al. |
| 10,973,888 B2 | 4/2021 | Agard et al. |
| 11,278,600 B2 | 3/2022 | Agard et al. |
| 2008/0220990 A1 | 9/2008 | Fox |
| 2009/0312196 A1 | 12/2009 | Colbeck et al. |
| 2011/0280856 A1 | 11/2011 | Selden et al. |
| 2012/0177722 A1 | 7/2012 | Weiner et al. |
| 2012/0328592 A1 | 12/2012 | Shulman et al. |
| 2013/0039898 A1 | 2/2013 | Okhamafe et al. |
| 2014/0005057 A1 | 1/2014 | Clark et al. |
| 2014/0214391 A1 | 7/2014 | Cope |
| 2014/0221216 A1 | 8/2014 | Cope et al. |
| 2015/0050658 A1 | 2/2015 | Cho |
| 2015/0133307 A1 | 5/2015 | Zhang et al. |
| 2015/0134315 A1 | 5/2015 | Sarmiento et al. |
| 2017/0216411 A1 | 8/2017 | Treco et al. |
| 2017/0360900 A1 | 12/2017 | Agard et al. |
| 2018/0148703 A1 | 5/2018 | Shulman et al. |
| 2020/0199563 A1 | 6/2020 | Hallows et al. |
| 2020/0360489 A1 | 11/2020 | Agard et al. |
| 2020/0360490 A1 | 11/2020 | Agard et al. |
| 2020/0405826 A1 | 12/2020 | Agard et al. |

FOREIGN PATENT DOCUMENTS

| | | | |
|---|---|---|---|
| WO | 95/22625 A1 | 8/1995 | |
| WO | 96/00787 A1 | 1/1996 | |
| WO | 97/0078 A1 | 1/1997 | |
| WO | 97/35966 A1 | 10/1997 | |
| WO | 98/11206 A2 | 3/1998 | |
| WO | 98/27230 A1 | 6/1998 | |
| WO | 2000/42651 A1 | 7/2000 | |
| WO | 2001/75767 A2 | 10/2001 | |
| WO | 2009/152336 A1 | 12/2009 | |
| WO | 2010/144103 A1 | 12/2010 | |
| WO | 2012/170930 A9 | 12/2012 | |
| WO | 2013/156552 A1 | 10/2013 | |
| WO | 2016/105889 A1 | 6/2016 | |
| WO | 2020/132252 A2 | 6/2020 | |
| WO | WO-2021026447 A1 * | 2/2021 | ..... C12Y 302/01022 |
| WO | 2021/173928 A2 | 9/2021 | |

OTHER PUBLICATIONS

Altschul, S.F., et al., "Gapped BLAST and PSI-BLAST: a new generation of protein database search programs," Nucleic Acids Res., 25(17):3389-3402 [1997].

Beaucage, S.L., et al., "Deoxynucleoside phosphoamidites—A new class of key intermediates for deoxypolynucleotide synthesis," Tetrahedron Letters, 22(20):1859-62 [1981].

Black, M.E., et al., "Creation of drug-specific herpes simplex virus type 1 thymidine kinase mutants for gene therapy," Proc Natl Acad Sci USA, 93:3525-3529 [1996].

Botstein, D., et al., "Strategies and applications of in vitro mutagenesis," Science, 229(4719):1193-1201 [1985].

Caldwell, R.C., et al., "Mutagenic PCR," PCR Methods Appl., 3:S136-S140 [1994].

Carter, P., "Site-directed mutagenesis," Biochem. J., 237:1-7 [1986].

Christians, F.C., et al., "Directed evolution of thymidine kinase for AZT phosphorylation using DNA family shuffling," Nat. Biotechnol., 17:259-264 [1999].

Crameri, A., et al., "DNA shuffling of a family of genes from diverse species accelerates directed evolution", Nature, 391:288-291 [1998].

Crameri, A., et al., "Improved green fluorescent protein by molecular evolution using DNA shuffling,"Nat. Biotechnol., 14(3):315-319 [1996].

Crameri, A., et al., "Molecular evolution of an arsenate detoxification pathway by DNA shuffling," Nat. Biotechnol., 15 (5):436-438 [1997].

Dale, S.J., et al., "Oligonucleotide-directed random mutagenesis using the phosphorothioate method," Methods Mol. Biol., 57:369-74 [1996].

Durant, B., et al., "Sex differences of urinary and kidneyglobotriaosylceramide and lyso-globotriaosylceramide inFabry mice," J. Lipid Res., 52:1742-6 [2011].

Guo, Z., et al., "3'-End-Forming Signals of Yeast mRNA," Mol. Cell. Biol., 15(11):5983-5990 [1995].

Henikoff, S., et al., "Amino acid substitution matrices from protein blocks," Proc. Natl. Acad. Sci., 89:10915-10919 [1992].

Ikeda, K., et al., "Phenylalanine ammonia-lyase modified with polyethylene glycol: Potential therapeutic agent for phenylketonuria," Amino Acids, 29:283-287 [2005].

(56) References Cited

OTHER PUBLICATIONS

Kramer, B., et al., "Different base/base mismatches are corrected with different efficiencies by the methyl-directed DNA mismatch-repair system of *E. coli*," Cell, 38(3):879-887, [1984].
Ling, M., et al., "Approaches to DNA Mutagenesis:An Overview," Anal. Biochem., 254:157-78 [1997].
Matthes, H.W.D., et al., "Simultaneous rapid chemical synthesis of over one hundred oligonucleotides on a microscale," EMBO J , 3(4):801-05 [1984].
Mcilvaine, T.C., "A Buffer Solution for Colorimetric Comparison," J. Biol. Chem., 49:183-186 [1921].
Minshull, J., et al., "Protein evolution by molecular breeding," Curr. Op. Chem. Biol., 3(3):284-290 [1999].
Nance, C.S., et al., "Later-Onset Fabry Disease; An Adult Variant Presenting With the Cramp-Fasciculation Syndrome," Arch. Neurol., 63:453-457 [2006].
Needleman, S., et al., "A general method applicable to the search for similarities in the amino acid sequence of two proteins," J. Mol. Biol. 48:443-453 [1970].
Pearson, W.R., "Improved tools for biological sequence comparison," Proc. Natl. Acad. Sci. USA, 85:2444-2448 [1988].
Provencal, P., et al., "Relative distribution of Gb3 isoforms/analogsin NOD/SCID/Fabry mice tissues determined by tandem mass spectrometry," Bioanal., 8(17):1793-1807 [2016].
Romanos, M.A., et al., "Foreign gene expression in yeast: a review," Yeast 8:423-488 [1992].
Schiffmann, R., "Fabry disease," Pharm. Ther., 122:65-77 [2009].
Smith, M., "In vitro mutagenesis," Ann. Rev. Genet., 19:423-462 [1985].
Smith, T., et al., "Comparison of Biosequences," Adv. Appl. Math, 2:482-489 [1981].
Stemmer, W., "DNA Shuffling by Random Fragmentation and Reassembly: In vitro Recombination for Molecular Evolution," Proc. Natl. Acad. Sci. USA, 91:10747-10751 [1994].
Stemmer, W.P.C., "Rapid evolution of a protein in vitro by DNA shuffling", Nature, 370:389-391 [1994].
Wang, R.Y., et al., "Lysosomal storage diseases: Diagnostic confirmation and management of presymptomatic individuals," Genet. Med., 13:457-484 [2011].
Wells, J.A., et al., "Cassette mutagenesis: an efficient method for generation of multiple mutations at defined sites," Gene, 34:315-323 [1985].
Yasuda, K., et al., "Efficient and rapid purification of recombinant human α-galactosidase A by affinity column chromatography," Prof. Exp. Pur,. 37(2):499-506 [2004].
Zhang, J-H., et al., "Directed evolution of a fucosidase from a galactosidase by DNA shuffling and screening ," Proc. Nat. Acad. Sci., U.S.A., 94:4504-4509 [1997].
Zhao, H., et al., "Molecular evolution by staggered extension process (StEP) in vitro recombination," Nat. Biotechnol., 16:258-261 [1998].
UniProt Accession No. P06280 dated Dec. 5, 2018.
Southwood, S., et al., "Several Common HLA-DR Types Share Largely Overlapping Peptide Binding Repertoires," J. Immunol., 160:3363-3373 [1998].
Vita, R., et al., "The Immune Epitope Database 2.0," Nucl. Acids Res., 38(Database issue): D854-62 [2010].
UniProt Database Accession No. F1PFD0 dated May 3, 2011.
UniProt Database Accession No. J3S8S8 dated Oct. 31, 2012.
UniProt Database Accession No. G1LPQ5 dated Oct. 19, 2011.
Guce, A.I., et al., "Catalytic Mechanism of Human Alpha-Galactosidase", J. Biological Chemistry, 285(6):3625-3634 [2010].
GenBank Accession No. AAP36507.1 dated May 13, 2003.
Sugawara, K., et al., "Structural characterization of mutant alpha-galactosidases causing Fabry disease," J. Hum. Genet., 53(9):812-824 [2008].

\* cited by examiner

HUMAN ALPHA-GALACTOSIDASE VARIANTS

The present application claims priority to U.S. Prov. Appln. Ser. No. 62/782,553, filed Dec. 20, 2018, hereby incorporated by reference in its entirety for all purposes.

FIELD OF THE INVENTION

The present invention provides engineered human alpha-galactosidase polypeptides and compositions thereof. The engineered human alpha-galactosidase polypeptides have been optimized to provide improved thermostability, serum stability, reduced immunogenicity, improved cellular uptake, and stability under both acidic (pH<4) and basic (pH>7) conditions, and improved globotriaosylceramide clearance from cells. The invention also relates to the use of the compositions comprising the engineered human alpha-galactosidase polypeptides for therapeutic purposes.

REFERENCE TO SEQUENCE LISTING, TABLE OR COMPUTER PROGRAM

The official copy of the Sequence Listing is submitted concurrently with the specification as an ASCII formatted text file via EFS-Web, with a file name of "CX7-184WO2_ST25.txt", a creation date of Dec. 19, 2019, and a size of 1.67 megabytes. The Sequence Listing filed via EFS-Web is part of the specification and is incorporated in its entirety by reference herein.

BACKGROUND OF THE INVENTION

Human alpha galactosidase ("GLA"; EC 3.2.1.22) is a lysosomal glycoprotein responsible for hydrolyzing terminal alpha galactosyl moieties from glycolipids and glycoproteins. It works on many substrates present in a range of human tissues. Fabry disease (also referred to as angiokeratoma corporis *diffusum*, Anderson-Fabry disease, hereditary dystopic lipidosis, alpha-galactosidase A deficiency, GLA deficiency, and ceramide trihexosidase deficiency) is an X-linked inborn error of glycosphingolipid catabolism that results from deficient or absent activity of alpha-galactosidase A. Patients affected with Fabry disease accumulate globotriaosylceramide (referred to herein as "Gb$_3$" and "Gb3") and related glycosphingolipids in the plasma and cellular lysosomes of blood vessels, tissue and organs (See e.g., Nance et al., Arch. Neurol., 63:453-457 [2006]). As the patient ages, the blood vessels become progressively narrowed, due to the accumulation of these lipids, resulting in decreased blood flow and nourishment to the tissues, particularly in the skin, kidneys, heart, brain, and nervous system. Thus, Fabry disease is a systemic disorder that manifests as renal failure, cardiac disease, cerebrovascular disease, small-fiber peripheral neuropathy, and skin lesions, as well as other disorders (See e.g., Schiffmann, Pharm. Ther., 122:65-77 [2009]). Affected patients exhibit symptoms such as painful hands and feet, clusters of small, dark red spots on their skin, the decreased ability to sweat, corneal opacity, gastrointestinal issues, tinnitus, and hearing loss. Potentially life-threatening complications include progressive renal damage, heart attacks, and stroke. This disease affects an estimated 1 in 40,000-60,000 males, but also occurs in females. Indeed, heterozygous women with Fabry disease experience significant life-threatening conditions including nervous system abnormalities, chronic pain, fatigue, high blood pressure, heart disease, kidney failure, and stroke, thus requiring medical treatment (See e.g., Want et al., Genet. Med., 13:457-484 [2011]). Signs of Fabry disease can start any time from infancy on, with signs usually beginning to show between ages 4 and 8, although some patients exhibit a milder, late-onset disease. Treatment is generally supportive and there is no cure for Fabry disease, thus there remains a need for a safe and effective treatment.

SUMMARY OF THE INVENTION

The present invention provides engineered human alpha-galactosidase polypeptides and compositions thereof. The engineered human alpha-galactosidase polypeptides have been optimized to provide improved thermostability, serum stability, reduced immunogenicity, improved cellular uptake, and stability under both acidic (pH<4) and basic (pH>7) conditions, and improved globotriaosylceramide clearance from cells. The invention also relates to the use of the compositions comprising the engineered human alpha-galactosidase polypeptides for therapeutic purposes.

The present invention provides recombinant alpha galactosidase A and/or biologically active recombinant alpha galactosidase A fragment comprising an amino acid sequence comprising at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to SEQ ID NO:8. The present invention provides recombinant alpha galactosidase A and/or biologically active recombinant alpha galactosidase A fragment comprising an amino acid sequence comprising at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO:8.

The present invention also provides recombinant alpha galactosidase A wherein said comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 8, or a functional fragment thereof, and wherein said recombinant alpha galactosidase A comprises at least one substitution or substitution set at one or more positions selected from 44, 44/217, 44/217/316, 44/217/322, 44/217/322/337, 44/247, 44/247/302, 44/247/302/322, 44/247/322, 44/247/337, 44/247/362, 44/302, 44/337, 44/373, 217/322, 217/373, 247/322, 247/362, 302/322/362/373, 302/337, 316, 316/337, 322, 322/337, 362/373, and 373, wherein the amino acid positions of said polypeptide sequence are numbered with reference to SEQ ID NO: 8. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 8, or a functional fragment thereof, and wherein said recombinant alpha galactosidase A comprises at least one substitution or substitution set at one or more positions selected from 44L, 44L/217F, 44L/217F/316L, 44L/217F/322M, 44L/217F/322M/337A, 44L/247N, 44L/247N/302Q, 44L/247N/302Q/322M, 44L/247N/322M, 44L/247N/337A, 44L/247N/362K, 44L/302Q, 44L/337A, 44L/373R, 217F/322M, 217F/373R, 247N/322M, 247N/362K, 302Q/322M/362K/373R, 302Q/337A, 316L, 316L/337A, 322M, 322M/337A, 362K/373R, and 373R, wherein the amino acid positions of said polypeptide sequence are numbered with reference to SEQ ID NO: 8. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 8, or a functional fragment thereof, and wherein said recombinant alpha galactosidase A comprises at least one substitution or substitution set at one or more positions selected from R44L, R44L/R217F, R44L/R217F/D316L, R44L/R217F/I322M, R44L/R217F/I322M/P337A, R44L/D247N, R44L/D247N/K302Q, R44L/D247N/K302Q/I322M, R44L/D247N/I322M, R44L/D247N/P337A, R44L/D247N/Q362K, R44L/K302Q, R44L/P337A, R44L/K373R, R217F/I322M, R217F/K373R, D247N/I322M, D247N/Q362K, K302Q/I322M/Q362K/K373R, K302Q/P337A, D316L, D316L/P337A, I322M, I322M/P337A, Q362K/K373R, and K373R, wherein the amino acid positions of said polypeptide sequence are numbered with reference to SEQ ID NO: 8.

The present invention also provides recombinant alpha galactosidase A wherein said comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 8, or a functional fragment thereof, and wherein said recombinant alpha galactosidase A comprises at least one substitution or substitution set at one or more positions selected from 10/39/44/47/92/166/206/217/247/261/271/302/316/322/337/362/368/373/392, 44/217/316, 44/217/322/337, 166/362, 217/373, and 362/373, wherein the amino acid positions of said polypeptide sequence are numbered with reference to SEQ ID NO: 8. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 8, or a functional fragment thereof, and wherein said recombinant alpha galactosidase A comprises at least one substitution or substitution set at one or more positions selected from 10T/39M/44L/47S/92Y/166S/206K/217F/247N/261A/271H/302Q/316L/322M/337A/362K/368W/373R/392M, 44L/217F/316L, 44L/217F/322M/337A, 166A/362K, 217F/373R, and 362K/373R, wherein the amino acid positions of said polypeptide sequence are numbered with reference to SEQ ID NO: 8. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 8, or a functional fragment thereof, and wherein said recombinant alpha galactosidase A comprises at least one substitution or substitution set at one or more positions selected from P10T/E39M/R44L/T47S/H92Y/P166S/A206K/R217F/D247N/G261A/A271H/K302Q/D316L/I322M/P337A/Q362K/A368W/K373R/T392M, R44L/R217F/D316L, R44L/R217F/I322M/P337A, P166A/Q362K, R217F/K373R, and Q362K/K373R, wherein the amino acid positions of said polypeptide sequence are numbered with reference to SEQ ID NO: 8.

The present invention also provides recombinant alpha galactosidase A wherein said comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 58, or a functional fragment thereof, and wherein said recombinant alpha galactosidase A comprises at least one substitution or substitution set at one or more positions selected from 7, 7/48/68, 7/48/68/120/282/299, 7/48/130/282, 7/48/180, 7/68/130/282/365, 7/68/180, 7/88/120/305/365, 7/120, 7/130, 7/282, 7/305, 7/305/365, 7/365, 39, 47, 47/87/95/96/158/162, 47/95, 47/273, 47/343, 48, 48/68, 48/180/282, 48/282, 48/282/305, 67/180, 68, 68/299/300, 71, 87/91/95/96/158/162, 87/91/95/96/206/343, 87/96/155/273/343, 88, 91/95, 91/95/96, 92, 93, 96, 96/273, 96/312/343, 120, 120/299/305, 151, 158, 158/162/273, 162, 162/273, 162/343, 166, 178, 180, 181, 206, 217, 271, 273, 273/343, 282, 282/365, 293/391, 299/300, 299/300/305/365, 300, 301, 305, 305/365, 314, 333, 336, 337, 343, 345, 363, 365, 370, 389, 393, 394, 396/398, 397, and 398, wherein the amino acid positions of said polypeptide sequence are numbered with reference to SEQ ID NO: 58. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 58, or a functional fragment thereof, and wherein said recombinant alpha galactosidase A comprises at least one substitution or substitution set at one or more positions selected from 7L, 7L/48D/68E, 7L/48D/68E/120H/282N/299R, 7L/48D/130E/282N, 7L/48D/180G, 7L/68E/130E/282N/365V, 7L/68E/180G, 7L/88A/120H/305G/365V, 7L/120H, 7L/130E, 7L/282N, 7L/305G, 7L/305G/365V, 7L/365V, 39V, 47D, 47D/87K/95E/96L/158R/162H, 47D/95E, 47D/273P, 47D/343G, 47V, 48D, 48D/68E, 48D/180G/282N, 48D/282N, 48D/282N/305G, 67T/180G, 68E, 68E/299R/300I, 71P, 87K/91Q/95E/96L/158A/162K, 87K/91Q/95E/96L/206S/343G, 87K/96I/155N/273P/343G, 88A, 91Q/95E, 91Q/95E/96L, 92F, 92T, 93I, 96L, 96L/273P, 96L/312Q/343G, 120H, 120H/299R/305G, 151L, 158A, 158A/162K/273G, 158R, 162H/343D, 162K, 162K/273P, 162S, 166K, 178G, 178S, 180G, 180L, 180T, 180V, 181A, 206K, 206S, 217K, 271R, 273P, 273P/343G, 282N, 282N/365V, 293P/391A, 299R/300I, 299R/300I/305G/365V, 300I, 301M, 305G, 305G/365V, 314A, 333F, 333G, 336V, 337R, 343D, 343G, 345A, 345Q, 363Q, 365A, 365Q, 365V, 370G, 389K, 393V, 394K, 396G/398T, 397A, 398A, 398P, 398S, and 398V, wherein the amino acid positions of said polypeptide sequence are numbered with reference to SEQ ID NO: 58. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 58, or a functional fragment thereof, and wherein said recombinant alpha galactosidase A comprises at least one substitution or substitution set at one or more positions selected from R7L, R7L/E48D/Q68E, R7L/E48D/Q68E/Y120H/D282N/Q299R, R7L/E48D/D130E/D282N, R7L/E48D/F180G, R7L/Q68E/D130E/D282N/F365V, R7L/Q68E/F180G, R7L/Q88A/Y120H/N305G/F365V, R7L/Y120H, R7L/D130E, R7L/D282N, R7L/N305G, R7L/N305G/F365V, R7L/F365V, E39V, T47D, T47D/R87K/S95E/K96L/L158R/R162H, T47D/S95E, T47D/S273P, T47D/K343G, T47V, E48D, E48D/Q68E, E48D/F180G/D282N, E48D/D282N, E48D/D282N/N305G, P67T/F180G, Q68E, Q68E/Q299R/L300I, S71P, R87K/N91Q/S95E/K96L/L158A/R162K, R87K/N91Q/S95E/K96L/A206S/K343G, R87K/K96I/H155N/S273P/K343G, Q88A, N91Q/S95E, N91Q/S95E/K96L, H92F, H92T, V93I, K96L, K96L/S273P, K96L/P312Q/K343G, Y120H, Y120H/Q299R/N305G, D151L, L158A, L158A/R162K/S273G, L158R, R162H/K343D, R162K, R162K/S273P, R162S, P166K, W178G, W178S, F180G, F180L, F180T, F180V, Q181A, A206K, A206S, R217K, A271R, S273P, S273P/K343G, D282N, D282N/F365V, L293P/Q391A, Q299R/L300I, Q299R/L300I/N305G/F365V, L300I, R301M, N305G, N305G/F365V, S314A, S333F, S333G, I336V, P337R, K343D, K343G, V345A, V345Q, L363Q, F365A, F365Q, F365V, S370G, T389K, S393V, L394K, D396G/L398T, L397A, L398A, L398P, L398S, and L398V, wherein the amino acid positions of said polypeptide sequence are numbered with reference to SEQ ID NO: 58.

The present invention also provides recombinant alpha galactosidase A wherein said comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 158, or a functional fragment thereof, and wherein said recombinant alpha galactosidase A comprises at least one substitution or substitution set at one or more positions selected from 24/202, 39/47, 39/47/217, 39/151, 39/282/337/398, 39/337/343/398, 39/393/398, 47/130, 47/151, 47/343/345/393, 48, 48/68, 48/68/217/333/391/393, 48/68/333, 48/217, 48/333, 48/345/393, 48/393, 59/143, 68, 68/345, 130, 130/158, 130/158/393, 130/345/393, 143/271, 143/333, 143/387, 151, 151/158/217/343/345/393, 151/206/282/337/343/345/398, 151/282/393, 151/345/393/398, 151/393, 158, 158/393, 202, 206, 206/217, 217, 217/333, 217/337/345/398, 271, 282/393, 333, 333/345, 337/343/345/398, 343, 343/345/393/398, 393, and 393/398, wherein the amino acid positions of said polypeptide sequence are numbered with reference to SEQ ID NO: 158. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 158, or a functional fragment thereof, and wherein said recombinant alpha galactosidase A comprises at least one substitution or substitution set at one or more positions selected from 24S/202N, 39V/47D, 39V/47V/217K, 39V/151L, 39V/282N/337R/398A, 39V/337R/343G/398A, 39V/393V/398A, 47V/130E, 47V/151L, 47V/343D/345Q/393V, 48D, 48D/68E, 48D/68E/217K/333F/391A/393V, 48D/68E/333F, 48D/217K, 48D/333F, 48D/333G, 48D/345Q/393V, 48D/393V, 59A/143S, 68E, 68E/345Q, 130E, 130E/158R, 130E/158R/393V, 130E/345Q/393V, 143S/271N, 143S/333N, 143S/387N, 151L, 151L/158R/217K/343G/345Q/393V, 151L/206S/282N/337R/343D/345Q/398A, 151L/282N/393V, 151L/345Q/393V/398A, 151L/393V, 158R, 158R/393V, 202N, 206S, 206S/217K, 217K, 217K/333F, 217K/333G, 217K/337R/345Q/398A, 271N, 282N/393V, 333F/345Q, 333G, 333N, 337R/343G/345Q/398A, 343D, 343D/345Q/393V/398A, 393V, and 393V/398A, wherein the amino acid positions of said polypeptide sequence are numbered with reference to SEQ ID NO: 158. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 8, or a functional fragment thereof, and wherein said recombinant alpha galactosidase A comprises at least one substitution or substitution set at one or more positions selected from D24S/D202N, E39V/T47D, E39V/T47V/R217K, E39V/D151L, E39V/D282N/P337R/L398A, E39V/P337R/K343G/L398A, E39V/S393V/L398A, T47V/D130E, T47V/D151L, T47V/K343D/V345Q/S393V, E48D, E48D/Q68E, E48D/Q68E/R217K/5333F/Q391A/S393V, E48D/Q68E/S333F, E48D/R217K, E48D/S333F, E48D/S333G, E48D/V345Q/S393V, E48D/S393V, C59A/C143S, Q68E, Q68E/V345Q, D130E, D130E/L158R, D130E/L158R/S393V, D130E/V345Q/S393V, C143S/A271N, C143S/S333N, C143S/E387N, D151L, D151L/L158R/R217K/K343G/V345Q/S393V, D151L/A206S/D282N/P337R/K343D/V345Q/L398A, D151L/D282N/S393V, D151L/V345Q/S393V/L398A, D151L/S393V, L158R, L158R/S393V, D202N, A206S, A206S/R217K, R217K, R217K/5333F, R217K/5333G, R217K/P337R/V345Q/L398A, A271N, D282N/S393V, 5333F/V345Q, S333G, S333N, P337R/K343G/V345Q/L398A, K343D, K343D/V345Q/S393V/L398A, S393V, and S393V/L398A, wherein the amino acid positions of said polypeptide sequence are numbered with reference to SEQ ID NO: 158.

The present invention also provides recombinant alpha galactosidase A wherein said comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 372, or a functional fragment thereof, and wherein said recombinant alpha galactosidase A comprises at least one substitution or substitution set at one or more positions selected from 10, 10/39/44/322, 10/39/92/206/217/271, 10/39/92/247, 10/39/92/247/271/316, 10/44, 10/44/47/92/247, 10/44/47/261/302/322/368, 10/44/92/316/322, 10/44/261/302/316, 10/44/302/337/368, 10/47/217/247/316/392, 10/47/217/322, 10/47/271, 10/92, 10/92/206/217/247, 10/92/206/247/316/322/392, 10/92/206/247/322/368, 10/92/217/261/302/337, 10/206/217/271, 10/206/247, 10/206/261/271/316, 10/261, 10/271/302, 10/302, 10/302/316, 10/302/322/337, 10/316/322, 10/337/392, 10/368, 39/44/92/162/247/302/316/322, 39/44/92/217/322, 39/44/92/247/271/302, 39/47/92/247/302/316/322, 39/47/217/247/368, 39/47/247, 39/92/247/302/316/337/368, 39/92/316/322, 39/247/271, 39/247/271/316, 39/322, 44/47/92/206/217/316/322, 44/47/92/247/261/271/316/337/368, 44/47/206/217/247/271/322, 44/47/247/322/368, 44/47/302/316/322, 44/92/206/247/368, 44/206/337, 44/247/261/302/316, 44/247/261/302/316/322, 47/92/247/271, 47/217/302, 47/247, 47/247/271, 89/217/247/261/302/316, 92/217/271, 92/247, 92/247/271/322, 92/247/302/322/337, 92/271/337, 92/302, 92/316, 206/217/271/392, 217/247/316/322/337/368, 247, 247/271, 247/302, 271, 271/302/322, 271/316/322, 302/322/368, and 368, wherein the amino acid positions of said polypeptide sequence are numbered with reference to SEQ ID NO: 372. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 372, or a functional fragment thereof, and wherein said recombinant alpha galactosidase A comprises at least one substitution or substitution set at one or more positions selected from 10P, 10P/39E/44R/322I, 10P/39E/92H/206A/217R/271A, 10P/39E/92H/247D, 10P/39E/92H/247D/271A/316D, 10P/44R, 10P/44R/47T/92H/247D, 10P/44R/47T/261G/302K/322I/368A, 10P/44R/92H/316D/322I, 10P/44R/261G/302K/316D, 10P/44R/302K/337P/368A, 10P/47T/217R/247D/316D/392T, 10P/47T/217R/322I, 10P/47T/271A, 10P/92H, 10P/92H/206A/217R/247D, 10P/92H/206A/247D/316D/322I/392T, 10P/92H/206A/247D/322I/368A, 10P/92H/217R/261G/302K/337P, 10P/206A/217R/271A, 10P/206A/247D, 10P/206A/261G/271A/316D, 10P/261G, 10P/271A/302K, 10P/302K, 10P/302K/316D, 10P/302K/322I/337P, 10P/316D/322I, 10P/337P/392T, 10P/368A, 39E/44R/92H/162M/247D/302K/316D/322I, 39E/44R/92H/217R/322I, 39E/44R/92H/247D/271A/302K, 39E/47T/92H/247D/302K/316D/322I, 39E/47T/217R/247D/368A, 39E/47T/247D, 39E/92H/247D/302K/316D/337P/368A, 39E/92H/316D/322I, 39E/247D/271A, 39E/247D/271A/316D, 39E/322I, 44R/47T/92H/206A/217R/316D/322I, 44R/47T/92H/247D/261G/271A/316D/337P/368A, 44R/47T/206A/217R/247D/271A/322I, 44R/47T/247D/322I/368A, 44R/47T/302K/316D/322I, 44R/92H/206A/247D/368A, 44R/206A/337P, 44R/247D/261G/302K/316D, 44R/247D/261G/302K/316D/322I, 47T/92H/247D/271A, 47T/217R/302K, 47T/247D, 47T/247D/271A, 89I/217R/247D/261G/302K/316D, 92H/ 217R/271A, 92H/247D, 92H/247D/271A/322I, 92H/247D/ 302K/322I/337P, 92H/271A/337P, 92H/302K, 92H/316D, 206A/217R/271A/392T, 217R/247D/316D/322I/337P/ 368A, 247D, 247D/271A, 247D/302K, 271A, 271A/302K/ 322I, 271A/316D/322I, 302K/322I/368A, and 368A, wherein the amino acid positions of said polypeptide sequence are numbered with reference to SEQ ID NO: 372. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 372, or a functional fragment thereof, and wherein said recombinant alpha galactosidase A comprises at least one substitution or substitution set at one or more positions selected from T10P, T10P/M39E/L44R/M322I, T10P/ M39E/Y92H/K206A/F217R/H271A, T10P/M39E/Y92H/ N247D, T10P/M39E/Y92H/N247D/H271A/L316D, T10P/ L44R, T10P/L44R/S47T/Y92H/N247D, T10P/L44R/S47T/ A261G/Q302K/M322I/W368A, T10P/L44R/Y92H/L316D/ M322I, T10P/L44R/A261G/Q302K/L316D, T10P/L44R/ Q302K/A337P/W368A, T10P/S47T/F217R/N247D/ L316D/M392T, T10P/S47T/F217R/M322I, T10P/S47T/ H271A, T10P/Y92H, T10P/Y92H/K206A/F217R/N247D, T10P/Y92H/K206A/N247D/L316D/M322I/M392T, T10P/ Y92H/K206A/N247D/M322I/W368A, T10P/Y92H/F217R/ A261G/Q302K/A337P, T10P/K206A/F217R/H271A, T10P/K206A/N247D, T10P/K206A/A261G/H271A/ L316D, T10P/A261G, T10P/H271A/Q302K, T10P/Q302K, T10P/Q302K/L316D, T10P/Q302K/M322I/A337P, T10P/ L316D/M322I, T10P/A337P/M392T, T10P/W368A, M39E/ L44R/Y92H/R162M/N247D/Q302K/L316D/M322I, M39E/L44R/Y92H/F217R/M322I, M39E/L44R/Y92H/ N247D/H271A/Q302K, M39E/S47T/Y92H/N247D/ Q302K/L316D/M322I, M39E/S47T/F217R/N247D/ W368A, M39E/S47T/N247D, M39E/Y92H/N247D/ Q302K/L316D/A337P/W368A, M39E/Y92H/L316D/ M322I, M39E/N247D/H271A, M39E/N247D/H271A/ L316D, M39E/M322I, L44R/S47T/Y92H/K206A/F217R/ L316D/M322I, L44R/S47T/Y92H/N247D/A261G/H271A/ L316D/A337P/W368A, L44R/S47T/K206A/F217R/ N247D/H271A/M322I, L44R/S47T/N247D/M322I/ W368A, L44R/S47T/Q302K/L316D/M322I, L44R/Y92H/ K206A/N247D/W368A, L44R/K206A/A337P, L44R/ N247D/A261G/Q302K/L316D, L44R/N247D/A261G/ Q302K/L316D/M322I, S47T/Y92H/N247D/H271A, S47T/ F217R/Q302K, S47T/N247D, S47T/N247D/H271A, L89I/ F217R/N247D/A261G/Q302K/L316D, Y92H/F217R/ H271A, Y92H/N247D, Y92H/N247D/H271A/M322I, Y92H/N247D/Q302K/M322I/A337P, Y92H/H271A/ A337P, Y92H/Q302K, Y92H/L316D, K206A/F217R/ H271A/M392T, F217R/N247D/L316D/M322I/A337P/ W368A, N247D, N247D/H271A, N247D/Q302K, H271A, H271A/Q302K/M322I, H271A/L316D/M322I, Q302K/ M322I/W368A, and W368A, wherein the amino acid positions of said polypeptide sequence are numbered with reference to SEQ ID NO: 372.

The present invention also provides recombinant alpha galactosidase A wherein said comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 374, or a functional fragment thereof, and wherein said recombinant alpha galactosidase A comprises at least one substitution or substitution set at one or more positions selected from 10/36/92/166/ 247/261/316/392, 10/39, 10/39/44/47/92/206/217, 10/39/44/ 47/316, 10/39/44/47/337, 10/39/44/92/166/261/316/322, 10/39/44/92/166/302/322, 10/39/44/92/166/392, 10/39/44/ 92/217/302/322, 10/39/44/92/302/322, 10/39/44/166/261/ 271/316/322, 10/39/44/392, 10/39/47/92/337, 10/39/92/131/ 166/271/316/322, 10/39/92/166/217/247/271, 10/39/92/ 217/316, 10/44/47/166/261/271, 10/44/47/166/271/322/368, 10/44/47/217/271/316/322, 10/44/92, 10/44/92/217/247/ 271/302/316/392, 10/44/166/302, 10/44/206/316/322, 10/47/92/166/271/316/337, 10/47/92/271/302, 10/47/92/ 316/322/392, 10/47/166/271, 10/47/166/316, 10/92/166, 10/92/166/217/247/261/271, 10/92/166/261/271/392, 10/92/166/261/316/322/337, 10/92/166/337/368, 10/92/ 302/337, 10/92/316/322, 10/206, 10/206/247/261, 10/217/ 322, 10/261, 10/261/337/392, 10/316/392, 10/368, 39/44/ 47/92/166/206/392, 39/44/47/92/206/247/261, 39/44/47/92/ 206/392, 39/44/47/206/337/368/392, 39/44/92/166/247/ 261/302/337, 39/44/166/271, 39/44/166/271/337/368/392, 39/47/92/316/322, 39/47/92/392, 39/47/166/217/261/392, 39/47/217/247/368, 39/47/247, 39/92/166/217/392, 39/92/ 261/302, 39/166/217/261/316/368, 39/322, 39/392, 44/47, 44/47/92/217/271, 44/47/92/217/316/322/392, 44/47/92/ 392, 44/47/166, 44/47/166/271, 44/47/247/271/392, 44/316/ 322/392, 44/337, 47/166/206/217/247/337, 47/166/217/271/ 337, 47/206, 47/217/247/261, 47/271, 52/217/302/316, 92/166/206/271/316, 92/166/217/261/271/392, 92/166/217/ 316/337/392, 92/166/247, 92/166/316, 92/206/322, 92/217, 92/217/271/337, 92/261/271, 92/271, 166/217/316/322/337, 166/247/271/316, 166/316/322/337, 206/217, 217/392, 247/ 316, 316/322/368, and 316/337/392, wherein the amino acid positions of said polypeptide sequence are numbered with reference to SEQ ID NO: 374. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 374, or a functional fragment thereof, and wherein said recombinant alpha galactosidase A comprises at least one substitution or substitution set at one or more positions selected from 10T/36M/92Y/ 166S/247N/261A/316L/392M, 10T/39M, 10T/39M/44L/ 47S/92Y/206K/217F, 10T/39M/44L/47S/316L, 10T/39M/ 44L/47S/337A, 10T/39M/44L/92Y/166S/261A/316L/ 322M, 10T/39M/44L/92Y/166S/302Q/322M, 10T/39M/ 44L/92Y/166S/392M, 10T/39M/44L/92Y/217F/302Q/ 322M, 10T/39M/44L/92Y/302Q/322M, 10T/39M/44L/ 166S/261A/271H/316L/322M, 10T/39M/44L/392M, 10T/ 39M/47S/92Y/337A, 10T/39M/92Y/131G/166S/271H/ 316L/322M, 10T/39M/92Y/166S/217F/247N/271H, 10T/ 39M/92Y/217F/316L, 10T/44L/47S/166S/261A/271H, 10T/44L/47S/166S/271H/322M/368W, 10T/44L/47S/217F/ 271H/316L/322M, 10T/44L/92Y, 10T/44L/92Y/217F/ 247N/271H/302Q/316L/392M, 10T/44L/166S/302Q, 10T/ 44L/206K/316L/322M, 10T/47S/92Y/166S/271H/316L/ 337A, 10T/47S/92Y/271H/302Q, 10T/47S/92Y/316L/ 322M/392M, 10T/47S/166S/271H, 10T/47S/166S/316L, 10T/92Y/166S, 10T/92Y/166S/217F/247N/261A/271H, 10T/92Y/166S/261A/271H/392M, 10T/92Y/166S/261A/ 316L/322M/337A, 10T/92Y/166S/337A/368W, 10T/92Y/ 302Q/337A, 10T/92Y/316L/322M, 10T/206K, 10T/206K/ 247N/261A, 10T/217F/322M, 10T/261A, 10T/261A/337A/ 392M, 10T/316L/392M, 10T/368W, 39M/44L/47S/92Y/ 166S/206K/392M, 39M/44L/47S/92Y/206K/247N/261A, 39M/44L/47S/92Y/206K/392M, 39M/44L/47S/206K/ 337A/368W/392M, 39M/44L/92Y/166S/247N/261A/302Q/ 337A, 39M/44L/166S/271H, 39M/44L/166S/271H/337A/ 368W/392M, 39M/47S/92Y/316L/322M, 39M/47S/92Y/ 392M, 39M/47S/166S/217F/261A/392M, 39M/47S/217F/ 247N/368W, 39M/47S/247N, 39M/92Y/166S/217F/392M, 39M/92Y/261A/302Q, 39M/166S/217F/261A/316L/368W, 39M/322M, 39M/392M, 44L/47S, 44L/47S/92Y/217F/ 271H, 44L/47S/92Y/217F/316L/322M/392M, 44L/47S/ 92Y/392M, 44L/47S/166S, 44L/47S/166S/271H, 44L/47S/ 247N/271H/392M, 44L/316L/322M/392M, 44L/337A, 47S/166S/206K/217F/247N/337A, 47S/166S/217F/271H/ 337A, 47S/206K, 47S/217F/247N/261A, 47S/271H, 52N/ 217F/302Q/316L, 92Y/166S/206K/271H/316L, 92Y/166S/ 217F/261A/271H/392M, 92Y/166S/217F/316L/337A/ 392M, 92Y/166S/247N, 92Y/166S/316L, 92Y/206K/322M, 92Y/217F, 92Y/217F/271H/337A, 92Y/261A/271H, 92Y/ 271H, 166S/217F/316L/322M/337A, 166S/247N/271H/ 316L, 166S/316L/322M/337A, 206K/217F, 217F/392M, 247N/316L, 316L/322M/368W, and 316L/337A/392M, wherein the amino acid positions of said polypeptide sequence are numbered with reference to SEQ ID NO: 374. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 374, or a functional fragment thereof, and wherein said recombinant alpha galactosidase A comprises at least one substitution or substitution set at one or more positions selected from P10T/K36M/H92Y/P166S/D247N/G261A/ D316L/T392M, P10T/E39M, P10T/E39M/R44L/T47S/ H92Y/A206K/R217F, P10T/E39M/R44L/T47S/D316L, P10T/E39M/R44L/T47S/P337A, P10T/E39M/R44L/H92Y/ P166S/G261A/D316L/I322M, P10T/E39M/R44L/H92Y/ P166S/K302Q/I322M, P10T/E39M/R44L/H92Y/P166S/ T392M, P10T/E39M/R44L/H92Y/R217F/K302Q/I322M, P10T/E39M/R44L/H92Y/K302Q/I322M, P10T/E39M/ R44L/P166S/G261A/A271H/D316L/I322M, P10T/E39M/ R44L/T392M, P10T/E39M/T47S/H92Y/P337A, P10T/ E39M/H92Y/W131G/P166S/A271H/D316L/I322M, P10T/ E39M/H92Y/P166S/R217F/D247N/A271H, P10T/E39M/ H92Y/R217F/D316L, P10T/R44L/T47S/P166S/G261A/ A271H, P10T/R44L/T47S/P166S/A271H/I322M/A368W, P10T/R44L/T47S/R217F/A271H/D316L/I322M, P10T/ R44L/H92Y, P10T/R44L/H92Y/R217F/D247N/A271H/ K302Q/D316L/T392M, P10T/R44L/P166S/K302Q, P10T/ R44L/A206K/D316L/I322M, P10T/T47S/H92Y/P166S/ A271H/D316L/P337A, P10T/T47S/H92Y/A271H/K302Q, P10T/T47S/H92Y/D316L/I322M/T392M, P10T/T47S/ P166S/A271H, P10T/T47S/P166S/D316L, P10T/T47S/ P166S, P10T/H92Y/P166S/R217F/D247N/G261A/A271H, P10T/H92Y/P166S/G261A/A271H/T392M, P10T/H92Y/ P166S/G261A/D316L/I322M/P337A, P10T/H92Y/P166S/ P337A/A368W, P10T/H92Y/K302Q/P337A, P10T/H92Y/ D316L/I322M, P10T/A206K, P10T/A206K/D247N/ G261A, P10T/R217F/I322M, P10T/G261A, P10T/G261A/ P337A/T392M, P10T/D316L/T392M, P10T/A368W, E39M/R44L/T47S/H92Y/P166S/A206K/T392M, E39M/ R44L/T47S/H92Y/A206K/D247N/G261A, E39M/R44L/ T47S/H92Y/A206K/T392M, E39M/R44L/T47S/A206K/ P337A/A368W/T392M, E39M/R44L/H92Y/P166S/ D247N/G261A/K302Q/P337A, E39M/R44L/P166S/ A271H, E39M/R44L/P166S/A271H/P337A/A368W/ T392M, E39M/T47S/H92Y/D316L/I322M, E39M/T47S/ H92Y/T392M, E39M/T47S/P166S/R217F/G261A/T392M, E39M/T47S/R217F/D247N/A368W, E39M/T47S/D247N, E39M/H92Y/P166S/R217F/T392M, E39M/H92Y/G261A/ K302Q, E39M/P166S/R217F/G261A/D316L/A368W, E39M/I322M, E39M/T392M, R44L/T47S, R44L/T47S/ H92Y/R217F/A271H, R44L/T47S/H92Y/R217F/D316L/ I322M/T392M, R44L/T47S/H92Y/T392M, R44L/T47S/ P166S, R44L/T47S/P166S/A271H, R44L/T47S/D247N/ A271H/T392M, R44L/D316L/I322M/T392M, R44L/ P337A, T47S/P166S/A206K/R217F/D247N/P337A, T47 S/P166S/R217F/A271H/P337A, T47S/A206K, T47S/ R217F/D247N/G261A, T47S/A271H, D52N/R217F/ K302Q/D316L, H92Y/P166S/A206K/A271H/D316L, H92Y/P166S/R217F/G261A/A271H/T392M, H92Y/ P166S/R217F/D316L/P337A/T392M, H92Y/P166S/ D247N, H92Y/P166S/D316L, H92Y/A206K/I322M, H92Y/R217F, H92Y/R217F/A271H/P337A, H92Y/G261A/ A271H, H92Y/A271H, P166S/R217F/D316L/I322M/ P337A, P166S/D247N/A271H/D316L, P166S/D316L/ I322M/P337A, A206K/R217F, R217F/T392M, D247N/ D316L, D316L/I322M/A368W, and D316L/P337A/T392M, wherein the amino acid positions of said polypeptide sequence are numbered with reference to SEQ ID NO: 374.

In some embodiments, the alpha galactosidase A of the present invention comprises at least one mutation in at least one position as provided in Table 2-1, 5-1, 6-1, 7-1, 8-1, and/or 9-1, wherein the positions are numbered with reference to SEQ ID NO: 2. In some additional embodiments, the recombinant alpha galactosidase A is derived from a human alpha galactosidase A. In some further embodiments, the recombinant alpha galactosidase A comprises the polypeptide sequence of SEQ ID NO: 8, 58, 158, 372, and/or 374.

In some embodiments, the recombinant alpha galactosidase A is more thermostable than the alpha galactosidase A of SEQ ID NO: 2, 8, 58, 158, 372, and/or 374. In some additional embodiments, the recombinant alpha galactosidase A is more stable at pH 7 than the alpha galactosidase A of SEQ ID NO: 2, 8, 58, 158, 372, and/or 374. In yet some additional embodiments, the recombinant alpha galactosidase A is more stable at pH 4 than the alpha galactosidase A of SEQ ID NO: 2, 8, 58, 158, 372, and/or 374. In still some further embodiments, the recombinant alpha galactosidase A is more stable at pH 7 and more stable at pH 4 than the alpha galactosidase A of SEQ ID NO: 2, 8, 58, 158, 372, and/or 374. In still additional embodiments, the recombinant alpha galactosidase A is more stable to exposure to serum than the alpha galactosidase A of SEQ ID NO: 2, 8, 58, 158, 372, and/or 374. In some further embodiments, the recombinant alpha galactosidase A is more lysosomally stable than the alpha galactosidase A of SEQ ID NO:2, 8, 58, 158, 372, and/or 374. In yet some additional embodiments, the recombinant alpha galactosidase A is more readily taken up by cells than the alpha galactosidase A of SEQ ID NO: 2, 8, 58, 158, 372, and/or 374. In some further embodiments, the recombinant alpha galactosidase A depletes more globotriaosylceramide from cells than the alpha galactosidase A of SEQ ID NO: 2, 8, 58, 158, 372, and/or 374. In yet some additional embodiments, the recombinant alpha galactosidase A exhibits improved uptake into cells, as compared to SEQ ID NO: 2, 8, 58, 158, 372, and/or 374. In some further embodiments, the recombinant alpha galactosidase A is less immunogenic than the alpha galactosidase A of SEQ ID NO: 2, 8, 58, 158, 372, and/or 374. In some further embodiments, the recombinant alpha galactosidase A exhibits at least one improved property selected from: i) enhanced catalytic activity; ii) increased tolerance to pH 7; iii) increased tolerance to pH 4; iv) increased tolerance to serum; v) improved uptake into cells; vi) reduced immunogenicity; or vii) increased depletion of globotriaosylceramide from cells; or a combination of any of i), ii), iii), iv), v), vi) or vii), as compared to a reference sequence. In some embodiments, the reference sequence is SEQ ID NO: 2, 8, 58, 158, 372, and/or 374. In some further embodiments, the recombinant alpha galactosidase A is purified.

The present invention also provides recombinant polynucleotide sequences encoding at least one recombinant alpha galactosidase A as provided herein (e.g., in Table 2-1, 5-1, 6-1, 7-1, 8-1, and/or 9-1). In some embodiments, the polynucleotide sequence is selected from DNA, RNA, and mRNA.

In some embodiments, the recombinant polynucleotide sequence is codon-optimized.

The present invention also provides expression vectors comprising the recombinant polynucleotide sequence encoding at least one recombinant alpha galactosidase A as provided herein (e.g., Table 2-1, 5-1, 6-1, 7-1, 8-1, and/or 9-1). In some embodiments, the recombinant polynucleotide sequence is operably linked to a control sequence. In some additional embodiments, the control sequence is a promoter. In some further embodiments, the promoter is a heterologous promoter. In some embodiments, the expression vector further comprises a signal sequence, as provided herein.

The present invention also provides host cells comprising at least one expression vector as provided herein. In some embodiments, the host cell comprises an expression vector comprising the recombinant polynucleotide sequence encoding at least one recombinant alpha galactosidase A as provided herein (e.g., Table 2-1, 5-1, 6-1, 7-1, 8-1, and/or 9-1). In some embodiments, the host cell is selected from eukaryotes and prokaryotes. In some embodiments, the host cell is eukaryotic. In some additional embodiments, the host cell is a mammalian cell.

The present invention also provides methods of producing an alpha galactosidase A variant, comprising culturing a host cell provided herein, under conditions that the alpha galactosidase A encoded by the recombinant polynucleotide is produced. In some embodiments, the methods further comprise the step of recovering alpha galactosidase A. In some further embodiments, the methods further comprise the step of purifying the alpha galactosidase A. The present invention also provides compositions comprising at least one recombinant alpha galactosidase A as provided herein (e.g., Table 2-1, 5-1, 6-1, 7-1, 8-1, and/or 9-1). In some embodiments, the present invention provides pharmaceutical compositions. In some embodiments, the present invention provides pharmaceutical compositions comprising at least one recombinant polynucleotide provided herein. In some additional embodiments, the present invention provides pharmaceutical compositions for the treatment of Fabry disease, comprising an enzyme composition provided herein. In some embodiments, the pharmaceutical compositions, further comprise a pharmaceutically acceptable carrier and/or excipient. In some additional embodiments, the pharmaceutical composition is suitable for parenteral injection or infusion to a human.

The present invention also provides methods for treating and/or preventing the symptoms of Fabry disease in a subject, comprising providing a subject having Fabry disease, and providing at least one pharmaceutical composition compositions comprising at least one recombinant alpha galactosidase A as provided herein (e.g., Table 2-1, 5-1, 6-1, 7-1, 8-1, and/or 9-1), and administering the pharmaceutical composition to the subject. In some embodiments, the symptoms of Fabry disease are ameliorated in the subject. In some additional embodiments, the subject to whom the pharmaceutical composition of the present invention has been administered is able to eat a diet that is less restricted in its fat content than diets required by subjects exhibiting the symptoms of Fabry disease. In some embodiments, the subject is an infant or child, while in some alternative embodiments, the subject is an adult or young adult.

The present invention also provides for the use of the compositions provided herein.

DESCRIPTION OF THE INVENTION

Figure 1:
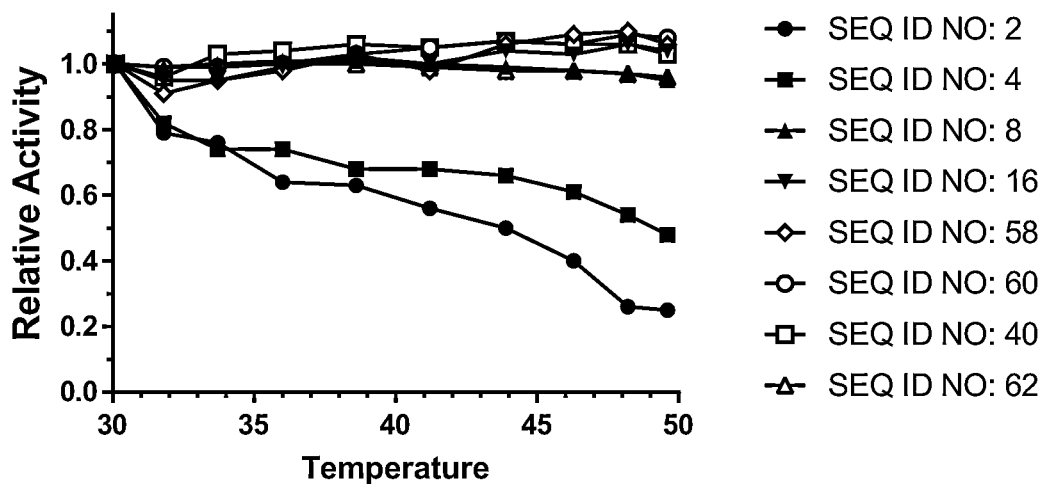
FIG. 1 provides a graph showing the relative activity of GLA variants after incubation for 1 hour at temperatures 30-50° C.

The present invention provides engineered human alpha-galactosidase polypeptides and compositions thereof. The engineered human alpha-galactosidase polypeptides have been optimized to provide improved thermostability, serum stability, improved cellular uptake, and stability under both acidic (pH<4) and basic (pH>7) conditions, reduced immunogenicity, and improved globotriaosylceramide clearance from cells. The invention also relates to the use of the compositions comprising the engineered human alpha-galactosidase polypeptides for therapeutic purposes.

In some embodiments, the engineered human alpha-galactosidase polypeptides have been optimized to provide improved cellular uptake while maintaining stability. The invention also relates to the use of the compositions comprising the engineered human alpha-galactosidase polypeptides for therapeutic purposes.

In some cases, enzyme replacement therapy for treatment of Fabry disease (e.g., FABRAZYME® agalsidase beta; Genzyme) is considered for eligible individuals. Currently used enzyme replacements therapies are recombinantly expressed forms of the wild-type human GLA. It is known that intravenously administered GLA circulates, is taken into cells via receptor-mediated endocytosis, primarily mannose 6-phosphate receptors (M6PR), and travels to the endosomes/lysosomes of target organs, where it clears accumulated of Gb3. These drugs do not completely relieve patient symptoms, as neuropathic pain and transient ischemic attacks continue to occur at reduced rates. In addition, the uptake of GLA by most target organs is poor in comparison to the highly vascularized and M6PR-rich liver, and the enzyme is unstable at the pH of blood and lysosomes. Thus, issues remain with available treatments. In addition, patients may develop an immune response (IgG and IgE antibodies targeting the administered drug), and suffer severe allergic (anaphylactic) reactions, severe infusion reactions, and even death. The present invention is intended to provide more stable and efficacious enzymes suitable for treatment of Fabry disease, yet with reduced side effects and improved outcomes, as compared to currently available treatments. Indeed, the present invention is intended to provide recombinant GLA enzymes that have increased stability in blood (pH 7.4), which the enzyme encounters upon introduction into the bloodstream. In addition, the enzyme has increased stability at the pH of the lysosome (pH 4.3), the location where the enzyme is active during therapy. Thus, directed evolution of recombinantly expressed human GLA in human HEK293T cells, employing high throughput screening of diverse enzyme variant libraries, was used to provide novel GLA variants with maintained stability properties, improved globotriaosylceramide clearance, and cellular uptake. In some embodiments, the GLA variants exhibit reduced immunogenicity.

Abbreviations and Definitions

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, biochemistry, organic chemistry, analytical chemistry and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses. All patents, patent applications, articles and publications mentioned herein, both supra and infra, are hereby expressly incorporated herein by reference.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the application as a whole. All patents, patent applications, articles and publications mentioned herein, both supra and infra, are hereby expressly incorporated herein by reference.

Also, as used herein, the singular "a", "an," and "the" include the plural references, unless the context clearly indicates otherwise.

Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

The term "about" means an acceptable error for a particular value. In some instances "about" means within 0.05%, 0.5%, 1.0%, or 2.0%, of a given value range. In some instances, "about" means within 1, 2, 3, or 4 standard deviations of a given value.

Furthermore, the headings provided herein are not limitations of the various aspects or embodiments of the invention which can be had by reference to the application as a whole. Accordingly, the terms defined immediately below are more fully defined by reference to the application as a whole. Nonetheless, in order to facilitate understanding of the invention, a number of terms are defined below.

Unless otherwise indicated, nucleic acids are written left to right in 5' to 3' orientation; amino acid sequences are written left to right in amino to carboxy orientation, respectively.

As used herein, the term "comprising" and its cognates are used in their inclusive sense (i.e., equivalent to the term "including" and its corresponding cognates).

"EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

"ATCC" refers to the American Type Culture Collection whose biorepository collection includes genes and strains.

"NCBI" refers to National Center for Biological Information and the sequence databases provided therein.

"Protein," "polypeptide," and "peptide" are used interchangeably herein to denote a polymer of at least two amino acids covalently linked by an amide bond, regardless of length or post-translational modification (e.g., glycosylation or phosphorylation).

"Amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes.

The term "engineered," "recombinant," "non-naturally occurring," and "variant," when used with reference to a cell, a polynucleotide or a polypeptide refers to a material or a material corresponding to the natural or native form of the material that has been modified in a manner that would not otherwise exist in nature or is identical thereto but produced or derived from synthetic materials and/or by manipulation using recombinant techniques.

As used herein, "UTR" refers to untranslated regions of an mRNA polynucleotide. In some embodiments, a "5' untranslated region" or "5'UTR" is referred to as a "leader sequence" or "leader RNA." This mRNA region is directly upstream from the initiation codon. In some embodiments, a "3' untranslated region" or "3'UTR" is an mRNA region directly downstream from the stop codon. In various organisms (e.g., prokaryotes, eukaryotes, and viruses), both of these regions are important for translation regulation and intracellular trafficking.

As used herein, "wild-type" and "naturally-occurring" refer to the form found in nature. For example, a wild-type polypeptide or polynucleotide sequence is a sequence present in an organism that can be isolated from a source in nature and which has not been intentionally modified by human manipulation.

"Coding sequence" refers to that part of a nucleic acid (e.g., a gene) that encodes an amino acid sequence of a protein.

The term "percent (%) sequence identity" is used herein to refer to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted, e.g., by the local homology algorithm of Smith and Waterman (Smith and Waterman, Adv. Appl. Math., 2:482 [1981]), by the homology alignment algorithm of Needleman and Wunsch (Needleman and Wunsch, J. Mol. Biol., 48:443 [1970]), by the search for similarity method of Pearson and Lipman (Pearson and Lipman, Proc. Natl. Acad. Sci. USA 85:2444 [1988]), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BLAST and BLAST 2.0 algorithms, which are described by Altschul et al. (See, Altschul et al., J. Mol. Biol., 215: 403-410 [1990]; and Altschul et al., 1977, Nucleic Acids Res., 3389-3402 [1977], respectively). Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (See, Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (See, Henikoff and Henikoff, Proc. Natl. Acad. Sci. USA 89:10915 [1989]). Exemplary determination of sequence alignment and % sequence identity can employ the BESTFIT or GAP programs in the GCG Wisconsin Software package (Accelrys, Madison Wis.), using default parameters provided.

"Reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, at least 100 residues in length or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence. "Comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

"Corresponding to", "reference to" or "relative to" when used in the context of the numbering of a given amino acid or polynucleotide sequence refers to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered GLA, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

"Amino acid difference" or "residue difference" refers to a difference in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X44 as compared to SEQ ID NO: 8" refers to a difference of the amino acid residue at the polypeptide position corresponding to position 44 of SEQ ID NO: 8. Thus, if the reference polypeptide of SEQ ID NO: 8 has a arginine at position 44, then a "residue difference at position X44 as compared to SEQ ID NO: 8" an amino acid substitution of any residue other than arginine at the position of the polypeptide corresponding to position 44 of SEQ ID NO: 8. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some instances (e.g., as shown in in Tables 2-1,5-1, 6-1, 7-1, 8-1, and 9-1), the present disclosure also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present disclosure can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X247D/X247N or X247D/N). In some embodiments, the enzyme variants comprise more than one substitution. These substitutions are separated by a slash for ease in reading (e.g., D24S/D202N). The present application includes engineered polypeptide sequences comprising one or more amino acid differences that include either/or both conservative and non-conservative amino acid substitutions.

"Conservative amino acid substitution" refers to a substitution of a residue with a different residue having a similar side chain, and thus typically involves substitution of the amino acid in the polypeptide with amino acids within the same or similar defined class of amino acids. By way of example and not limitation, an amino acid with an aliphatic side chain may be substituted with another aliphatic amino acid (e.g., alanine, valine, leucine, and isoleucine); an amino acid with hydroxyl side chain is substituted with another amino acid with a hydroxyl side chain (e.g., serine and threonine); an amino acids having aromatic side chains is substituted with another amino acid having an aromatic side chain (e.g., phenylalanine, tyrosine, tryptophan, and histidine); an amino acid with a basic side chain is substituted with another amino acid with a basis side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively.

"Non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

"Deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered enzyme. Deletions can be directed to the internal portions and/or terminal portions of the polypeptide. In various embodiments, the deletion can comprise a continuous segment or can be discontinuous.

"Insertion" refers to modification to the polypeptide by addition of one or more amino acids from the reference polypeptide. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

A "functional fragment" or a "biologically active fragment" used interchangeably herein refers to a polypeptide that has an amino-terminal and/or carboxy-terminal deletion(s) and/or internal deletions, but where the remaining amino acid sequence is identical to the corresponding positions in the sequence to which it is being compared (e.g., a full-length engineered GLA of the present invention) and that retains substantially all of the activity of the full-length polypeptide.

"Isolated polypeptide" refers to a polypeptide which is substantially separated from other contaminants that naturally accompany it (e.g., protein, lipids, and polynucleotides). The term embraces polypeptides which have been removed or purified from their naturally-occurring environment or expression system (e.g., host cell or in vitro synthesis). The recombinant GLA polypeptides may be present within a cell, present in the cellular medium, or prepared in various forms, such as lysates or isolated preparations. As such, in some embodiments, the recombinant GLA polypeptides can be an isolated polypeptide.

"Substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure GLA composition comprises about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated recombinant GLA polypeptides are substantially pure polypeptide compositions.

"Improved enzyme property" refers to an engineered GLA polypeptide that exhibits an improvement in any enzyme property as compared to a reference GLA polypeptide and/or as a wild-type GLA polypeptide or another engineered GLA polypeptide. Improved properties include, but are not limited to such properties as increased gene expression, increased protein production, increased thermoactivity, increased thermostability, increased activity at various pH levels, increased stability, increased enzymatic activity, increased substrate specificity or affinity, increased specific activity, increased resistance to substrate and/or product inhibition, increased chemical stability, improved chemoselectivity, improved solvent stability, increased tolerance to acidic, neutral, or basic pH, increased tolerance to proteolytic activity (i.e., reduced sensitivity to proteolysis), reduced aggregation, increased solubility, reduced immunogenicity, improved post-translational modification (e.g., glycosylation), altered temperature profile, increased cellular uptake, increased lysosomal stability, increased ability to deplete cells of Gb3, increased secretion from GLA producing cells, etc.

"Increased enzymatic activity" or "enhanced catalytic activity" refers to an improved property of the engineered GLA polypeptides, which can be represented by an increase in specific activity (e.g., product produced/time/weight protein) or an increase in percent conversion of the substrate to the product (e.g., percent conversion of starting amount of substrate to product in a specified time period using a specified amount of GLA) as compared to the reference GLA enzyme. Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.1 fold the enzymatic activity of the corresponding wild-type enzyme, to as much as 2-fold, 5-fold, 10-fold, 20-fold, 25-fold, 50-fold, 75-fold, 100-fold, 150-fold, 200-fold or more enzymatic activity than the naturally occurring GLA or another engineered GLA from which the GLA polypeptides were derived.

In some embodiments, the engineered GLA polypeptides have a $k_{cat}$ of at least 0.1/sec, at least 0.5/sec, at least 1.0/sec, at least 5.0/sec, at least 10.0/sec and in some preferred embodiments greater than 10.0/sec. In some embodiments, the $K_m$ is in the range of about 1 μM to about 5 mM; in the range of about 5 μM to about 2 mM; in the range of about 10 μM to about 2 mM; or in the range of about 10 μM to about 1 mM. In some specific embodiments, the engineered GLA enzyme exhibits improved enzymatic activity after exposure to certain conditions in the range of 1.5 to 10 fold, 1.5 to 25 fold, 1.5 to 50 fold, 1.5 to 100 fold or greater than that of a reference GLA enzyme (e.g., a wild-type GLA or any other reference GLA, such as SEQ ID NO: 8). GLA activity can be measured by any suitable method known in the art (e.g., standard assays, such as monitoring changes in spectrophotometric properties of reactants or products). In some embodiments, the amount of product produced can be measured by High-Performance Liquid Chromatography (HPLC) separation combined with UV absorbance or fluorescent detection directly or following o-phthaldialdehyde (OPA) derivatization. In some embodiments, the amount of product produced can be measured by monitoring fluorescence (Ex. 355 nm, Em. 460 nm) after hydrolysis of a 4-methylumbelliferyl-alpha-D-galactopyranoside (4-MU-Gal) molecule. Comparisons of enzyme activities are made using a defined preparation of enzyme, a defined assay under a set condition, and one or more defined substrates, as further described in detail herein. Generally, when lysates are compared, the numbers of cells and the amount of protein assayed are determined as well as use of identical expression systems and identical host cells to minimize variations in amount of enzyme produced by the host cells and present in the lysates.

The term "improved tolerance to acidic pH" means that a recombinant GLA according to the invention will have increased stability (higher retained activity at about pH 4.8 after exposure to acidic pH for a specified period of time (1 hour, up to 24 hours)) as compared to a reference GLA or another enzyme.

The term "improved cellular uptake" means that a recombinant GLA provided herein exhibits increased endocytosis into cells, as compared to a reference GLA (including wild-type GLA) or another enzyme. In some embodiments, the cells are cultured Fabry patient fibroblasts (higher retained intracellular activity after incubation with cultured cells over a specified period of time, as compared to a reference GLA or another enzyme). In some additional embodiments, the recombinant GLA provided herein exhibits greater retained intracellular activity with cultured cells over a specific period of time as compared to a reference GLA (including wild-type GLA) or another enzyme. In some additional embodiments, the time period is about 4 hours, while in some other embodiments, the time period is less than 4 hours (e.g., 1, 2, or 3 hours), and in some alternative embodiments, the time period is more than 4 hours (e.g., 5, 6, 7, 8, or more hours).

"Physiological pH" as used herein means the pH range generally found in a subject's (e.g., human) blood.

The term "basic pH" (e.g., used with reference to improved stability to basic pH conditions or increased tolerance to basic pH) means a pH range of about 7 to 11.

The term "acidic pH" (e.g., used with reference to improved stability to acidic pH conditions or increased tolerance to acidic pH) means a pH range of about 1.5 to 4.5.

"Conversion" refers to the enzymatic conversion (or biotransformation) of a substrate(s) to the corresponding product(s). "Percent conversion" refers to the percent of the substrate that is converted to the product within a period of time under specified conditions. Thus, the "enzymatic activity" or "activity" of a GLA polypeptide can be expressed as "percent conversion" of the substrate to the product in a specific period of time.

"Hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5×Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5×Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are described in the references cited above.

"Codon optimized" refers to changes in the codons of the polynucleotide encoding a protein such that the encoded protein is more efficiently expressed in the organism and/or cells of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the GLA enzymes may be codon optimized for optimal production from the host organism(s) and/or cell type(s) selected for expression accounting for GC content, cryptic splice sites, transcription termination signals, motifs that may affect RNA stability, and nucleic acid secondary structures, as well as any other factors of interest.

"Control sequence" refers herein to include all components, which are necessary or advantageous for the expression of a polynucleotide and/or polypeptide of the present application. Each control sequence may be native or foreign to the nucleic acid sequence encoding the polypeptide. Such control sequences include, but are not limited to, a leader, polyadenylation sequence, propeptide sequence, promoter sequence, signal peptide sequence, initiation sequence and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

"Promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

"Suitable reaction conditions" refers to those conditions in the enzymatic conversion reaction solution (e.g., ranges of enzyme loading, temperature, pH, buffers, co-solvents, etc.) under which a GLA polypeptide of the present application is capable of converting a substrate to the desired product compound, Exemplary "suitable reaction conditions" are provided in the present application and illustrated by the Examples. "Enzyme loading" refers to the concentration or amount of a component in a reaction mixture at the start of the reaction. "Substrate" in the context of an enzymatic conversion reaction process refers to the compound or molecule acted on by the GLA polypeptide. "Product" in the context of an enzymatic conversion process refers to the compound or molecule resulting from the action of the GLA polypeptide on a substrate.

As used herein the term "culturing" refers to the growing of a population of microbial, mammalian, or other suitable cells under any suitable conditions (e.g., using a liquid, gel or solid medium).

Recombinant polypeptides can be produced using any suitable methods known the art. Genes encoding the wild-type polypeptide of interest can be cloned in vectors, such as plasmids, and expressed in desired hosts, such as E. coli, S. cerevisiae, or mammalian cell lines (e.g., HEK, or CHO cells), etc. Variants of recombinant polypeptides can be generated by various methods known in the art. Indeed, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Non-limiting examples of methods used for DNA and protein engineering are provided in the following patents: U.S. Pat. Nos. 6,117,679; 6,420,175; 6,376,246; 6,586,182; 7,747,391; 7,747,393; 7,783,428; and 8,383,346. After the variants are produced, they can be screened for any desired property (e.g., high or increased activity, or low or reduced activity, increased thermal activity, increased thermal stability, and/or acidic pH stability, etc.). In some embodiments, "recombinant GLA polypeptides" (also referred to herein as "engineered GLA polypeptides," "variant GLA enzymes," and "GLA variants") find use.

As used herein, a "vector" is a DNA construct for introducing a DNA sequence into a cell. In some embodiments, the vector is an expression vector that is operably linked to a suitable control sequence capable of effecting the expression in a suitable host of the polypeptide encoded in the DNA sequence. In some embodiments, an "expression vector" has a promoter sequence operably linked to the DNA sequence (e.g., transgene) to drive expression in a host cell, and in some embodiments, also comprises a transcription terminator sequence.

As used herein, the term "gene therapy vector" refers to vehicles or carriers suitable for delivery of polynucleotide sequences to cells. In some embodiments, the vectors encapsulate genes (e.g., therapeutic genes) or polynucleotide sequences for delivery to cells or tissues, including but not limited to adenovirus (AV), adeno-associated virus (AAV), lentivirus (LV), and non-viral vectors, such as liposomes. It is not intended that the present invention be limited to any specific gene therapy vector, as any vehicle suitable for a given setting finds use. The gene therapy vector may be designed to deliver genes to a specific species or host, or may find more general applicability.

As used herein, the term "expression" includes any step involved in the production of the polypeptide including, but not limited to, transcription, post-transcriptional modification, translation, and post-translational modification. In some embodiments, the term also encompasses secretion of the polypeptide from a cell.

As used herein, the term "produces" refers to the production of proteins and/or other compounds by cells. It is intended that the term encompass any step involved in the production of polypeptides including, but not limited to, transcription, post-transcriptional modification, translation, and post-translational modification. In some embodiments, the term also encompasses secretion of the polypeptide from a cell.

As used herein, an amino acid or nucleotide sequence (e.g., a promoter sequence, signal peptide, terminator sequence, etc.) is "recombinant" or "heterologous" to another sequence with which it is operably linked if the two sequences are not associated in nature.

As used herein, the terms "host cell" and "host strain" refer to suitable hosts for expression vectors comprising DNA provided herein (e.g., the polynucleotides encoding the GLA variants). In some embodiments, the host cells are prokaryotic or eukaryotic cells that have been transformed or transfected with vectors constructed using recombinant DNA techniques as known in the art.

The term "analogue" means a polypeptide having more than 70% sequence identity but less than 100% sequence identity (e.g., more than 75%, 78%, 80%, 83%, 85%, 88%, 90%, 91%, 92%, 93%, 94%, 95%, 96%, 97%, 98%, 99% sequence identity) with a reference polypeptide. In some embodiments, "analogues" means polypeptides that contain one or more non-naturally occurring amino acid residues including, but not limited to, homoarginine, ornithine and norvaline, as well as naturally occurring amino acids. In some embodiments, analogues also include one or more D-amino acid residues and non-peptide linkages between two or more amino acid residues.

The term "therapeutic" refers to a compound administered to a subject who shows signs or symptoms of pathology having beneficial or desirable medical effects.

The term "pharmaceutical composition" refers to a composition suitable for pharmaceutical use in a mammalian subject (e.g., human) comprising a pharmaceutically effective amount of an engineered GLA polypeptide encompassed by the invention and an acceptable carrier.

The term "gene therapy" refers to the delivery of a gene, polydeoxyribonucleotide, or polynucleotide sequence(s) with a gene therapy vector to cells or tissues for the modification of those cells or tissues for the treatment of prevention of a disease. Gene therapy may include replacing a mutated gene that causes disease with a healthy copy of the gene, or inactivating, or "knocking out," a mutated gene that is functioning improperly. In some embodiments, gene therapy is used in the treatment of disease in patients.

The term "mRNA therapy" refers to the delivery of an mRNA polyribonucleotide sequence to cells or tissues for the modification of those cells or tissues for the treatment or prevention of a disease. In some embodiments, the mRNA polynucleotide sequences for delivery to cells or tissue, are formulated, for instance, but not limited to, in liposomes. In some embodiments, mRNA therapy is used in the treatment of disease in patients.

The term "cell therapy" refers to the delivery of living cells that have been modified exogenously to patients to provide a missing gene for the treatment or prevention of a disease. The modified cells are then reintroduced into the body.

The term "effective amount" means an amount sufficient to produce the desired result. One of general skill in the art may determine what the effective amount by using routine experimentation.

The terms "isolated" and "purified" are used to refer to a molecule (e.g., an isolated nucleic acid, polypeptide, etc.) or other component that is removed from at least one other component with which it is naturally associated. The term "purified" does not require absolute purity, rather it is intended as a relative definition.

The term "subject" encompasses mammals such as humans, non-human primates, livestock, companion animals, and laboratory animals (e.g., rodents and lagamorphs). It is intended that the term encompass females as well as males.

As used herein, the term "patient" means any subject that is being assessed for, treated for, or is experiencing disease.

The term "infant" refers to a child in the period of the first month after birth to approximately one (1) year of age. As used herein, the term "newborn" refers to child in the period from birth to the 28th day of life. The term "premature infant" refers to an infant born after the twentieth completed week of gestation, yet before full term, generally weighing ~500 to ~2499 grams at birth. A "very low birth weight infant" is an infant weighing less than 1500 g at birth.

As used herein, the term "child" refers to a person who has not attained the legal age for consent to treatment or research procedures. In some embodiments, the term refers to a person between the time of birth and adolescence.

As used herein, the term "adult" refers to a person who has attained legal age for the relevant jurisdiction (e.g., 18 years of age in the United States). In some embodiments, the term refers to any fully grown, mature organism. In some embodiments, the term "young adult" refers to a person less than 18 years of age, but who has reached sexual maturity.

As used herein, "composition" and "formulation" encompass products comprising at least one engineered GLA of the present invention, intended for any suitable use (e.g., pharmaceutical compositions, dietary/nutritional supplements, feed, etc.).

The terms "administration" and "administering" a composition mean providing a composition of the present invention to a subject (e.g., to a person suffering from the effects of Fabry disease).

The term "carrier" when used in reference to a pharmaceutical composition means any of the standard pharmaceutical carrier, buffers, and excipients, such as stabilizers, preservatives, and adjuvants.

The term "pharmaceutically acceptable" means a material that can be administered to a subject without causing any undesirable biological effects or interacting in a deleterious manner with any of the components in which it is contained and that possesses the desired biological activity.

As used herein, the term "excipient" refers to any pharmaceutically acceptable additive, carrier, diluent, adjuvant, or other ingredient, other than the active pharmaceutical ingredient (API; e.g., the engineered GLA polypeptides of the present invention). Excipients are typically included for formulation and/or administration purposes.

The term "therapeutically effective amount" when used in reference to symptoms of disease/condition refers to the amount and/or concentration of a compound (e.g., engineered GLA polypeptides) that ameliorates, attenuates, or eliminates one or more symptom of a disease/condition or prevents or delays the onset of symptom(s).

The term "therapeutically effective amount" when used in reference to a disease/condition refers to the amount and/or concentration of a composition (e.g., engineered GLA polypeptides) that ameliorates, attenuates, or eliminates the disease/condition. In some embodiments, the term is use in reference to the amount of a composition that elicits the biological (e.g., medical) response by a tissue, system, or animal subject that is sought by the researcher, physician, veterinarian, or other clinician.

It is intended that the terms "treating," "treat" and "treatment" encompass preventative (e.g., prophylactic), as well as palliative treatment.

Engineered GLA Expression and Activity:

Secreted expression of a yeast codon-optimized mature human GLA was achieved using a synthetic mouse IG signal peptide. Clones were expressed from a pCDNA3.1(+) vector in HEK293T cells. This approach provided supernatants with measurable activity on the fluorogenic substrate 4-methylumbelliferyl α-D-galactopyranoside (4-MuGal).

In some embodiments, to identify mutational diversity with similar stability and improved cellular uptake compared to SEQ ID NO: 8, a combinatorial library was constructed generating GLA variants derived from SEQ ID NO: 8. Equivalent volumes of supernatant were screened in an unchallenged condition (no incubation, pH 4.6) or following a one-hour incubation in a low pH (3.9-4.2), a neutral pH (7.0-7.6) or human serum (physiological pH 7.1-8.2) environment. GLA variants with activity due to increased GLA expression or GLA specific activity were identified based on their fold improvement over the parent GLA. GLA variants with increased stability were identified by dividing the fold-improvement observed under challenged conditions by the fold-improvement observed under unchallenged conditions. This approach reduces the bias towards selecting variants based on increased expression but without changes in specific activity at pH extremes. Composite activity scores (the product of fold-improvements for all three conditions) and stability (the product of stability scores) were used to rank mutations in improved variants for inclusion in subsequent GLA libraries. In additional embodiments, the additional methods and sequences described in the Examples were used.

Engineered GLA:

In some embodiments the engineered GLA which exhibits an improved property has at least about 85%, at least about 88%, at least about 90%, at least about 91%, at least about 92%, at least about 93%, at least about 94%, at least about 95%, at least about 96%, at least about 97%, at least about 98%, at least about 99%, or at about 100% amino acid sequence identity with SEQ ID NO: 2, 8, 48, 158, 372, and/or 374, and an amino acid residue difference as compared to SEQ ID NO: 2, 8, 48, 158, 372, and/or 374, at one or more amino acid positions (such as at 1, 2, 3, 4, 5, 6, 7, 8, 9, 10, 11, 12, 14, 15, 20 or more amino acid positions compared to SEQ ID NO: 2, 8, 48, 158, 372, and/or 374, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 2, 8, 48, 158, 372, and/or 374). In some embodiment the residue difference as compared to SEQ ID NO:5, at one or more positions include at least 1, 2, 3, 4, 5, 6, 7, 8, 9, 10 or more conservative amino acid substitutions. In some embodiments, the engineered GLA polypeptide is a polypeptide listed in Table 2-1, 5-1, 6-1, 7-1, 8-1, and/or 9-1. In some embodiments, the engineered GLA polypeptide comprises SEQ ID NO: 2, 8, 48, 158, 372, and/or 374.

The present invention also provides recombinant alpha galactosidase A wherein said comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 8, or a functional fragment thereof, and wherein said recombinant alpha galactosidase A comprises at least one substitution or substitution set at one or more positions selected from 44, 44/217, 44/217/316, 44/217/322, 44/217/322/337, 44/247, 44/247/302, 44/247/302/322, 44/247/322, 44/247/337, 44/247/362, 44/302, 44/337, 44/373, 217/322, 217/373, 247/322, 247/362, 302/322/362/373, 302/337, 316, 316/337, 322, 322/337, 362/373, and 373, wherein the amino acid positions of said polypeptide sequence are numbered with reference to SEQ ID NO: 8. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 8, or a functional fragment thereof, and wherein said recombinant alpha galactosidase A comprises at least one substitution or substitution set at one or more positions selected from 44L, 44L/217F, 44L/217F/316L, 44L/217F/322M, 44L/217F/322M/337A, 44L/247N, 44L/247N/302Q, 44L/247N/302Q/322M, 44L/247N/322M, 44L/247N/337A, 44L/247N/362K, 44L/302Q, 44L/337A, 44L/373R, 217F/322M, 217F/373R, 247N/322M, 247N/362K, 302Q/322M/362K/373R, 302Q/337A, 316L, 316L/337A, 322M, 322M/337A, 362K/373R, and 373R, wherein the amino acid positions of said polypeptide sequence are numbered with reference to SEQ ID NO: 8. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 8, or a functional fragment thereof, and wherein said recombinant alpha galactosidase A comprises at least one substitution or substitution set at one or more positions selected from R44L, R44L/R217F, R44L/R217F/D316L, R44L/R217F/I322M, R44L/R217F/I322M/P337A, R44L/D247N, R44L/D247N/K302Q, R44L/D247N/K302Q/I322M, R44L/D247N/I322M, R44L/D247N/P337A, R44L/D247N/Q362K, R44L/K302Q, R44L/P337A, R44L/K373R, R217F/I322M, R217F/K373R, D247N/I322M, D247N/Q362K, K302Q/I322M/Q362K/K373R, K302Q/P337A, D316L, D316L/P337A, I322M, I322M/P337A, Q362K/K373R, and K373R, wherein the amino acid positions of said polypeptide sequence are numbered with reference to SEQ ID NO: 8.

The present invention also provides recombinant alpha galactosidase A wherein said comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 8, or a functional fragment thereof, and wherein said recombinant alpha galactosidase A comprises at least one substitution or substitution set at one or more positions selected from 10/39/44/47/92/166/206/217/247/261/271/302/316/322/337/362/368/373/392, 44/217/316, 44/217/322/337, 166/362, 217/373, and 362/373, wherein the amino acid positions of said polypeptide sequence are numbered with reference to SEQ ID NO: 8. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 8, or a functional fragment thereof, and wherein said recombinant alpha galactosidase A comprises at least one substitution or substitution set at one or more positions selected from 10T/39M/44L/47S/92Y/166S/206K/217F/247N/261A/271H/302Q/316L/322M/337A/362K/368W/373R/392M, 44L/217F/316L, 44L/217F/322M/337A, 166A/362K, 217F/373R, and 362K/373R, wherein the amino acid positions of said polypeptide sequence are numbered with reference to SEQ ID NO: 8. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 8, or a functional fragment thereof, and wherein said recombinant alpha galactosidase A comprises at least one substitution or substitution set at one or more positions selected from P10T/E39M/R44L/T47S/ H92Y/P166S/A206K/R217F/D247N/G261A/A271H/ K302Q/D316L/I322M/P337A/Q362K/A368W/K373R/ T392M, R44L/R217F/D316L, R44L/R217F/I322M/P337A, P166A/Q362K, R217F/K373R, and Q362K/K373R, wherein the amino acid positions of said polypeptide sequence are numbered with reference to SEQ ID NO: 8.

The present invention also provides recombinant alpha galactosidase A wherein said comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 58, or a functional fragment thereof, and wherein said recombinant alpha galactosidase A comprises at least one substitution or substitution set at one or more positions selected from 7, 7/48/68, 7/48/68/120/282/299, 7/48/130/282, 7/48/180, 7/68/130/ 282/365, 7/68/180, 7/88/120/305/365, 7/120, 7/130, 7/282, 7/305, 7/305/365, 7/365, 39, 47, 47/87/95/96/158/162, 47/95, 47/273, 47/343, 48, 48/68, 48/180/282, 48/282, 48/282/305, 67/180, 68, 68/299/300, 71, 87/91/95/96/158/ 162, 87/91/95/96/206/343, 87/96/155/273/343, 88, 91/95, 91/95/96, 92, 93, 96, 96/273, 96/312/343, 120, 120/299/305, 151, 158, 158/162/273, 162, 162/273, 162/343, 166, 178, 180, 181, 206, 217, 271, 273, 273/343, 282, 282/365, 293/391, 299/300, 299/300/305/365, 300, 301, 305, 305/ 365, 314, 333, 336, 337, 343, 345, 363, 365, 370, 389, 393, 394, 396/398, 397, and 398, wherein the amino acid positions of said polypeptide sequence are numbered with reference to SEQ ID NO: 58. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 58, or a functional fragment thereof, and wherein said recombinant alpha galactosidase A comprises at least one substitution or substitution set at one or more positions selected from 7L, 7L/48D/68E, 7L/48D/68E/120H/282N/299R, 7L/48D/130E/282N, 7L/48D/180G, 7L/68E/130E/282N/365V, 7L/68E/180G, 7L/88A/120H/305G/365V, 7L/120H, 7L/130E, 7L/282N, 7L/305G, 7L/305G/365V, 7L/365V, 39V, 47D, 47D/87K/ 95E/96L/158R/162H, 47D/95E, 47D/273P, 47D/343G, 47V, 48D, 48D/68E, 48D/180G/282N, 48D/282N, 48D/282N/ 305G, 67T/180G, 68E, 68E/299R/300I, 71P, 87K/91Q/95E/ 96L/158A/162K, 87K/91Q/95E/96L/206S/343G, 87K/96I/ 155N/273P/343G, 88A, 91Q/95E, 91Q/95E/96L, 92F, 92T, 93I, 96L, 96L/273P, 96L/312Q/343G, 120H, 120H/299R/ 305G, 151L, 158A, 158A/162K/273G, 158R, 162H/343D, 162K, 162K/273P, 162S, 166K, 178G, 178S, 180G, 180L, 180T, 180V, 181A, 206K, 206S, 217K, 271R, 273P, 273P/ 343G, 282N, 282N/365V, 293P/391A, 299R/300I, 299R/ 300I/305G/365V, 300I, 301M, 305G, 305G/365V, 314A, 333F, 333G, 336V, 337R, 343D, 343G, 345A, 345Q, 363Q, 365A, 365Q, 365V, 370G, 389K, 393V, 394K, 396G/398T, 397A, 398A, 398P, 398S, and 398V, wherein the amino acid positions of said polypeptide sequence are numbered with reference to SEQ ID NO: 58.

In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 58, or a functional fragment thereof, and wherein said recombinant alpha galactosidase A comprises at least one substitution or substitution set at one or more positions selected from R7L, R7L/E48D/Q68E, R7L/E48D/ Q68E/Y120H/D282N/Q299R, R7L/E48D/D130E/D282N, R7L/E48D/F180G, R7L/Q68E/D130E/D282N/F365V, R7L/Q68E/F180G, R7L/Q88A/Y120H/N305G/F365V, R7L/Y120H, R7L/D130E, R7L/D282N, R7L/N305G, R7L/ N305G/F365V, R7L/F365V, E39V, T47D, T47D/R87K/ S95E/K96L/L158R/R162H, T47D/S95E, T47D/S273P, T47D/K343G, T47V, E48D, E48D/Q68E, E48D/F180G/ D282N, E48D/D282N, E48D/D282N/N305G, P67T/ F180G, Q68E, Q68E/Q299R/L300I, S71P, R87K/N91Q/ S95E/K96L/L158A/R162K, R87K/N91Q/S95E/K96L/ A206S/K343G, R87K/K96I/H155N/S273P/K343G, Q88A, N91Q/S95E, N91Q/S95E/K96L, H92F, H92T, V93I, K96L, K96L/S273P, K96L/P312Q/K343G, Y120H, Y120H/ Q299R/N305G, D151L, L158A, L158A/R162K/S273G, L158R, R162H/K343D, R162K, R162K/S273P, R162S, P166K, W178G, W178S, F180G, F180L, F180T, F180V, Q181A, A206K, A206S, R217K, A271R, S273P, S273P/ K343G, D282N, D282N/F365V, L293P/Q391A, Q299R/ L300I, Q299R/L300I/N305G/F365V, L300I, R301M, N305G, N305G/F365V, S314A, S333F, S333G, I336V, P337R, K343D, K343G, V345A, V345Q, L363Q, F365A, F365Q, F365V, 5370G, T389K, S393V, L394K, D396G/ L398T, L397A, L398A, L398P, L398S, and L398V, wherein the amino acid positions of said polypeptide sequence are numbered with reference to SEQ ID NO: 58.

The present invention also provides recombinant alpha galactosidase A wherein said comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 158, or a functional fragment thereof, and wherein said recombinant alpha galactosidase A comprises at least one substitution or substitution set at one or more positions selected from 24/202, 39/47, 39/47/217, 39/151, 39/282/337/398, 39/337/343/398, 39/393/398, 47/130, 47/151, 47/343/345/393, 48, 48/68, 48/68/217/333/391/393, 48/68/333, 48/217, 48/333, 48/345/ 393, 48/393, 59/143, 68, 68/345, 130, 130/158, 130/158/ 393, 130/345/393, 143/271, 143/333, 143/387, 151, 151/ 158/217/343/345/393, 151/206/282/337/343/345/398, 151/ 282/393, 151/345/393/398, 151/393, 158, 158/393, 202, 206, 206/217, 217, 217/333, 217/337/345/398, 271, 282/ 393, 333, 333/345, 337/343/345/398, 343, 343/345/393/398, 393, and 393/398, wherein the amino acid positions of said polypeptide sequence are numbered with reference to SEQ ID NO: 158. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 158, or a functional fragment thereof, and wherein said recombinant alpha galactosidase A comprises at least one substitution or substitution set at one or more positions selected from 24S/202N, 39V/47D, 39V/47V/ 217K, 39V/151L, 39V/282N/337R/398A, 39V/337R/343G/ 398A, 39V/393V/398A, 47V/130E, 47V/151L, 47V/343D/ 345Q/393V, 48D, 48D/68E, 48D/68E/217K/333F/391A/ 393V, 48D/68E/333F, 48D/217K, 48D/333F, 48D/333G, 48D/345Q/393V, 48D/393V, 59A/143S, 68E, 68E/345Q, 130E, 130E/158R, 130E/158R/393V, 130E/345Q/393V, 143S/271N, 143S/333N, 143S/387N, 151L, 151L/158R/ 217K/343G/345Q/393V, 151L/206S/282N/337R/343D/ 345Q/398A, 151L/282N/393V, 151L/345Q/393V/398A, 151L/393V, 158R, 158R/393V, 202N, 206S, 206S/217K, 217K, 217K/333F, 217K/333G, 217K/337R/345Q/398A, 271N, 282N/393V, 333F/345Q, 333G, 333N, 337R/343G/ 345Q/398A, 343D, 343D/345Q/393V/398A, 393V, and 393V/398A, wherein the amino acid positions of said polypeptide sequence are numbered with reference to SEQ ID NO: 158. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 8, or a functional fragment thereof, and wherein said recombinant alpha galactosidase A comprises at least one substitution or substitution set at one or more positions selected from D24S/D202N, E39V/T47D, E39V/T47V/R217K, E39V/D151L, E39V/D282N/P337R/L398A, E39V/P337R/K343G/L398A, E39V/S393V/L398A, T47V/D130E, T47V/D151L, T47V/K343D/V345Q/S393V, E48D, E48D/Q68E, E48D/Q68E/R217K/5333F/Q391A/S393V, E48D/Q68E/S333F, E48D/R217K, E48D/S333F, E48D/S333G, E48D/V345Q/S393V, E48D/S393V, C59A/C143S, Q68E, Q68E/V345Q, D130E, D130E/L158R, D130E/L158R/S393V, D130E/V345Q/S393V, C143S/A271N, C143S/S333N, C143S/E387N, D151L, D151L/L158R/R217K/K343G/V345Q/S393V, D151L/A206S/D282N/P337R/K343D/V345Q/L398A, D151L/D282N/S393V, D151L/V345Q/S393V/L398A, D151L/S393V, L158R, L158R/S393V, D202N, A206S, A206S/R217K, R217K, R217K/5333F, R217K/5333G, R217K/P337R/V345Q/L398A, A271N, D282N/S393V, 5333F/V345Q, S333G, S333N, P337R/K343G/V345Q/L398A, K343D, K343D/V345Q/S393V/L398A, S393V, and S393V/L398A, wherein the amino acid positions of said polypeptide sequence are numbered with reference to SEQ ID NO: 158.

The present invention also provides recombinant alpha galactosidase A wherein said comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 372, or a functional fragment thereof, and wherein said recombinant alpha galactosidase A comprises at least one substitution or substitution set at one or more positions selected from 10, 10/39/44/322, 10/39/92/206/217/271, 10/39/92/247, 10/39/92/247/271/316, 10/44, 10/44/47/92/247, 10/44/47/261/302/322/368, 10/44/92/316/322, 10/44/261/302/316, 10/44/302/337/368, 10/47/217/247/316/392, 10/47/217/322, 10/47/271, 10/92, 10/92/206/217/247, 10/92/206/247/316/322/392, 10/92/206/247/322/368, 10/92/217/261/302/337, 10/206/217/271, 10/206/247, 10/206/261/271/316, 10/261, 10/271/302, 10/302, 10/302/316, 10/302/322/337, 10/316/322, 10/337/392, 10/368, 39/44/92/162/247/302/316/322, 39/44/92/217/322, 39/44/92/247/271/302, 39/47/92/247/302/316/322, 39/47/217/247/368, 39/47/247, 39/92/247/302/316/337/368, 39/92/316/322, 39/247/271, 39/247/271/316, 39/322, 44/47/92/206/217/316/322, 44/47/92/247/261/271/316/337/368, 44/47/206/217/247/271/322, 44/47/247/322/368, 44/47/302/316/322, 44/92/206/247/368, 44/206/337, 44/247/261/302/316, 44/247/261/302/316/322, 47/92/247/271, 47/217/302, 47/247, 47/247/271, 89/217/247/261/302/316, 92/217/271, 92/247, 92/247/271/322, 92/247/302/322/337, 92/271/337, 92/302, 92/316, 206/217/271/392, 217/247/316/322/337/368, 247, 247/271, 247/302, 271, 271/302/322, 271/316/322, 302/322/368, and 368, wherein the amino acid positions of said polypeptide sequence are numbered with reference to SEQ ID NO: 372. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 372, or a functional fragment thereof, and wherein said recombinant alpha galactosidase A comprises at least one substitution or substitution set at one or more positions selected from 10P, 10P/39E/44R/322I, 10P/39E/92H/206A/217R/271A, 10P/39E/92H/247D, 10P/39E/92H/247D/271A/316D, 10P/44R, 10P/44R/47T/92H/247D, 10P/44R/47T/261G/302K/322I/368A, 10P/44R/92H/316D/322I, 10P/44R/261G/302K/316D, 10P/44R/302K/337P/368A, 10P/47T/217R/247D/316D/392T, 10P/47T/217R/322I, 10P/47T/271A, 10P/92H, 10P/92H/206A/217R/247D, 10P/92H/206A/247D/316D/322I/392T, 10P/92H/206A/247D/322I/368A, 10P/92H/217R/261G/302K/337P, 10P/206A/217R/271A, 10P/206A/247D, 10P/206A/261G/271A/316D, 10P/261G, 10P/271A/302K, 10P/302K, 10P/302K/316D, 10P/302K/322I/337P, 10P/316D/322I, 10P/337/392T, 10P/368A, 39E/44R/92H/162M/247D/302K/316D/322I, 39E/44R/92H/217R/322I, 39E/44R/92H/247D/271A/302K, 39E/47T/92H/247D/302K/316D/322I, 39E/47T/217R/247D/368A, 39E/47T/247D, 39E/92H/247D/302K/316D/337P/368A, 39E/92H/316D/322I, 39E/247D/271A, 39E/247D/271A/316D, 39E/322I, 44R/47T/92H/206A/217R/316D/322I, 44R/47T/92H/247D/261G/271A/316D/337P/368A, 44R/47T/206A/217R/247D/271A/322I, 44R/47T/247D/322I/368A, 44R/47T/302K/316D/322I, 44R/92H/206A/247D/368A, 44R/206A/337P, 44R/247D/261G/302K/316D, 44R/247D/261G/302K/316D/322I, 47T/92H/247D/271A, 47T/217R/302K, 47T/247D, 47T/247D/271A, 89I/217R/247D/261G/302K/316D, 92H/217R/271A, 92H/247D, 92H/247D/271A/322I, 92H/247D/302K/322I/337P, 92H/271A/337P, 92H/302K, 92H/316D, 206A/217R/271A/392T, 217R/247D/316D/322I/337P/368A, 247D, 247D/271A, 247D/302K, 271A, 271A/302K/322I, 271A/316D/322I, 302K/322I/368A, and 368A, wherein the amino acid positions of said polypeptide sequence are numbered with reference to SEQ ID NO: 372. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 372, or a functional fragment thereof, and wherein said recombinant alpha galactosidase A comprises at least one substitution or substitution set at one or more positions selected from T10P, T10P/M39E/L44R/M322I, T10P/M39E/Y92H/K206A/F217R/H271A, T10P/M39E/Y92H/N247D, T10P/M39E/Y92H/N247D/H271A/L316D, T10P/L44R, T10P/L44R/S47T/Y92H/N247D, T10P/L44R/S47T/A261G/Q302K/M322I/W368A, T10P/L44R/Y92H/L316D/M322I, T10P/L44R/A261G/Q302K/L316D, T10P/L44R/Q302K/A337P/W368A, T10P/S47T/F217R/N247D/L316D/M392T, T10P/S47T/F217R/M322I, T10P/S47T/H271A, T10P/Y92H, T10P/Y92H/K206A/F217R/N247D, T10P/Y92H/K206A/N247D/L316D/M322I/M392T, T10P/Y92H/K206A/N247D/M322I/W368A, T10P/Y92H/F217R/A261G/Q302K/A337P, T10P/K206A/F217R/H271A, T10P/K206A/N247D, T10P/K206A/A261G/H271A/L316D, T10P/A261G, T10P/H271A/Q302K, T10P/Q302K, T10P/Q302K/L316D, T10P/Q302K/M322I/A337P, T10P/L316D/M322I, T10P/A337P/M392T, T10P/W368A, M39E/L44R/Y92H/R162M/N247D/Q302K/L316D/M322I, M39E/L44R/Y92H/F217R/M322I, M39E/L44R/Y92H/N247D/H271A/Q302K, M39E/S47T/Y92H/N247D/Q302K/L316D/M322I, M39E/S47T/F217R/N247D/W368A, M39E/S47T/N247D, M39E/Y92H/N247D/Q302K/L316D/A337P/W368A, M39E/Y92H/L316D/M322I, M39E/N247D/H271A, M39E/N247D/H271A/L316D, M39E/M322I, L44R/S47T/Y92H/K206A/F217R/L316D/M322I, L44R/S47T/Y92H/N247D/A261G/H271A/L316D/A337P/W368A, L44R/S47T/K206A/F217R/N247D/H271A/M322I, L44R/S47T/N247D/M322I/W368A, L44R/S47T/Q302K/L316D/M322I, L44R/Y92H/K206A/N247D/W368A, L44R/K206A/A337P, L44R/N247D/A261G/Q302K/L316D, L44R/N247D/A261G/Q302K/L316D/M322I, S47T/Y92H/N247D/H271A, S47T/F217R/Q302K, S47T/N247D, S47T/N247D/H271A, L89I/F217R/N247D/A261G/Q302K/L316D, Y92H/F217R/H271A, Y92H/N247D, Y92H/N247D/H271A/M322I, Y92H/N247D/Q302K/M322I/A337P, Y92H/H271A/ A337P, Y92H/Q302K, Y92H/L316D, K206A/F217R/ H271A/M392T, F217R/N247D/L316D/M322I/A337P/ W368A, N247D, N247D/H271A, N247D/Q302K, H271A, H271A/Q302K/M322I, H271A/L316D/M322I, Q302K/ M322I/W368A, and W368A, wherein the amino acid positions of said polypeptide sequence are numbered with reference to SEQ ID NO: 372.

The present invention also provides recombinant alpha galactosidase A wherein said comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 374, or a functional fragment thereof, and wherein said recombinant alpha galactosidase A comprises at least one substitution or substitution set at one or more positions selected from 10/36/92/166/ 247/261/316/392, 10/39, 10/39/44/47/92/206/217, 10/39/44/ 47/316, 10/39/44/47/337, 10/39/44/92/166/261/316/322, 10/39/44/92/166/302/322, 10/39/44/92/166/392, 10/39/44/ 92/217/302/322, 10/39/44/92/302/322, 10/39/44/166/261/ 271/316/322, 10/39/44/392, 10/39/47/92/337, 10/39/92/131/ 166/271/316/322, 10/39/92/166/217/247/271, 10/39/92/ 217/316, 10/44/47/166/261/271, 10/44/47/166/271/322/368, 10/44/47/217/271/316/322, 10/44/92, 10/44/92/217/247/ 271/302/316/392, 10/44/166/302, 10/44/206/316/322, 10/47/92/166/271/316/337, 10/47/92/271/302, 10/47/92/ 316/322/392, 10/47/166/271, 10/47/166/316, 10/92/166, 10/92/166/217/247/261/271, 10/92/166/261/271/392, 10/92/166/261/316/322/337, 10/92/166/337/368, 10/92/ 302/337, 10/92/316/322, 10/206, 10/206/247/261, 10/217/ 322, 10/261, 10/261/337/392, 10/316/392, 10/368, 39/44/ 47/92/166/206/392, 39/44/47/92/206/247/261, 39/44/47/92/ 206/392, 39/44/47/206/337/368/392, 39/44/92/166/247/ 261/302/337, 39/44/166/271, 39/44/166/271/337/368/392, 39/47/92/316/322, 39/47/92/392, 39/47/166/217/261/392, 39/47/217/247/368, 39/47/247, 39/92/166/217/392, 39/92/ 261/302, 39/166/217/261/316/368, 39/322, 39/392, 44/47, 44/47/92/217/271, 44/47/92/217/316/322/392, 44/47/92/ 392, 44/47/166, 44/47/166/271, 44/47/247/271/392, 44/316/ 322/392, 44/337, 47/166/206/217/247/337, 47/166/217/271/ 337, 47/206, 47/217/247/261, 47/271, 52/217/302/316, 92/166/206/271/316, 92/166/217/261/271/392, 92/166/217/ 316/337/392, 92/166/247, 92/166/316, 92/206/322, 92/217/ 92/217/271/337, 92/261/271, 92/271, 166/217/316/322/337, 166/247/271/316, 166/316/322/337, 206/217, 217/392, 247/ 316, 316/322/368, and 316/337/392, wherein the amino acid positions of said polypeptide sequence are numbered with reference to SEQ ID NO: 374. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 374, or a functional fragment thereof, and wherein said recombinant alpha galactosidase A comprises at least one substitution or substitution set at one or more positions selected from 10T/36M/92Y/ 166S/247N/261A/316L/392M, 10T/39M, 10T/39M/44L/ 47S/92Y/206K/217F, 10T/39M/44L/47S/316L, 10T/39M/ 44L/47S/337A, 10T/39M/44L/92Y/166S/261A/316L/ 322M, 10T/39M/44L/92Y/166S/302Q/322M, 10T/39M/ 44L/92Y/166S/392M, 10T/39M/44L/92Y/217F/302Q/ 322M, 10T/39M/44L/92Y/302Q/322M, 10T/39M/44L/ 166S/261A/271H/316L/322M, 10T/39M/44L/392M, 10T/ 39M/47S/92Y/337A, 10T/39M/92Y/131G/166S/271H/ 316L/322M, 10T/39M/92Y/166S/217F/247N/271H, 10T/ 39M/92Y/217F/316L, 10T/44L/47S/166S/261A/271H, 10T/44L/47S/166S/271H/322M/368W, 10T/44L/47S/217F/ 271H/316L/322M, 10T/44L/92Y, 10T/44L/92Y/217F/ 247N/271H/302Q/316L/392M, 10T/44L/166S/302Q, 10T/ 44L/206K/316L/322M, 10T/47S/92Y/166S/271H/316L/ 337A, 10T/47S/92Y/271H/302Q, 10T/47S/92Y/316L/ 322M/392M, 10T/47S/166S/271H, 10T/47S/166S/316L, 10T/92Y/166S, 10T/92Y/166S/217F/247N/261A/271H, 10T/92Y/166S/261A/271H/392M, 10T/92Y/166S/261A/ 316L/322M/337A, 10T/92Y/166S/337A/368W, 10T/92Y/ 302Q/337A, 10T/92Y/316L/322M, 10T/206K, 10T/206K/ 247N/261A, 10T/217F/322M, 10T/261A, 10T/261A/337A/ 392M, 10T/316L/392M, 10T/368W, 39M/44L/47S/92Y/ 166S/206K/392M, 39M/44L/47S/92Y/206K/247N/261A, 39M/44L/47S/92Y/206K/392M, 39M/44L/47S/206K/ 337A/368W/392M, 39M/44L/92Y/166S/247N/261A/302Q/ 337A, 39M/44L/166S/271H, 39M/44L/166S/271H/337A/ 368W/392M, 39M/47S/92Y/316L/322M, 39M/47S/92Y/ 392M, 39M/47S/166S/217F/261A/392M, 39M/47S/217F/ 247N/368W, 39M/47S/247N, 39M/92Y/166S/217F/392M, 39M/92Y/261A/302Q, 39M/166S/217F/261A/316L/368W, 39M/322M, 39M/392M, 44L/47S, 44L/47S/92Y/217F/ 271H, 44L/47S/92Y/217F/316L/322M/392M, 44L/47S/ 92Y/392M, 44L/47S/166S, 44L/47S/166S/271H, 44L/47S/ 247N/271H/392M, 44L/316L/322M/392M, 44L/337A, 47S/166S/206K/217F/247N/337A, 47S/166S/217F/271H/ 337A, 47S/206K, 47S/217F/247N/261A, 47S/271H, 52N/ 217F/302Q/316L, 92Y/166S/206K/271H/316L, 92Y/166S/ 217F/261A/271H/392M, 92Y/166S/217F/316L/337A/ 392M, 92Y/166S/247N, 92Y/166S/316L, 92Y/206K/322M, 92Y/217F, 92Y/217F/271H/337A, 92Y/261A/271H, 92Y/ 271H, 166S/217F/316L/322M/337A, 166S/247N/271H/ 316L, 166S/316L/322M/337A, 206K/217F, 217F/392M, 247N/316L, 316L/322M/368W, and 316L/337A/392M, wherein the amino acid positions of said polypeptide sequence are numbered with reference to SEQ ID NO: 374. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 374, or a functional fragment thereof, and wherein said recombinant alpha galactosidase A comprises at least one substitution or substitution set at one or more positions selected from P10T/K36M/H92Y/P166S/D247N/G261A/ D316L/T392M, P10T/E39M, P10T/E39M/R44L/T47S/ H92Y/A206K/R217F, P10T/E39M/R44L/T47S/D316L, P10T/E39M/R44L/T47S/P337A, P10T/E39M/R44L/H92Y/ P166S/G261A/D316L/I322M, P10T/E39M/R44L/H92Y/ P166S/K302Q/I322M, P10T/E39M/R44L/H92Y/P166S/ T392M, P10T/E39M/R44L/H92Y/R217F/K302Q/I322M, P10T/E39M/R44L/H92Y/K302Q/I322M, P10T/E39M/ R44L/P166S/G261A/A271H/D316L/I322M, P10T/E39M/ R44L/T392M, P10T/E39M/T47S/H92Y/P337A, P10T/ E39M/H92Y/W131G/P166S/A271H/D316L/I322M, P10T/ E39M/H92Y/P166S/R217F/D247N/A271H, P10T/E39M/ H92Y/R217F/D316L, P10T/R44L/T47S/P166S/G261A/ A271H, P10T/R44L/T47S/P166S/A271H/I322M/A368W, P10T/R44L/T47S/R217F/A271H/D316L/I322M, P10T/ R44L/H92Y, P10T/R44L/H92Y/R217F/D247N/A271H/ K302Q/D316L/T392M, P10T/R44L/P166S/K302Q, P10T/ R44L/A206K/D316L/I322M, P10T/T47S/H92Y/P166S/ A271H/D316L/P337A, P10T/T47S/H92Y/A271H/K302Q, P10T/T47S/H92Y/D316L/I322M/T392M, P10T/T47S/ P166S/A271H, P10T/T47S/P166S/D316L, P10T/H92Y/ P166S, P10T/H92Y/P166S/R217F/D247N/G261A/A271H, P10T/H92Y/P166S/G261A/A271H/T392M, P10T/H92Y/ P166S/G261A/D316L/I322M/P337A, P10T/H92Y/P166S/ P337A/A368W, P10T/H92Y/K302Q/P337A, P10T/H92Y/ D316L/I322M, P10T/A206K, P10T/A206K/D247N/ G261A, P10T/R217F/I322M, P10T/G261A, P10T/G261A/

P337A/T392M, P10T/D316L/T392M, P10T/A368W, E39M/R44L/T47S/H92Y/P166S/A206K/T392M, E39M/R44L/T47S/H92Y/A206K/D247N/G261A, E39M/R44L/T47S/H92Y/A206K/T392M, E39M/R44L/T47S/A206K/P337A/A368W/T392M, E39M/R44L/H92Y/P166S/D247N/G261A/K302Q/P337A, E39M/R44L/P166S/A271H, E39M/R44L/P166S/A271H/P337A/A368W/T392M, E39M/T47S/H92Y/D316L/I322M, E39M/T47S/H92Y/T392M, E39M/T47S/P166S/R217F/G261A/T392M, E39M/T47S/R217F/D247N/A368W, E39M/T47S/D247N, E39M/H92Y/P166S/R217F/T392M, E39M/H92Y/G261A/K302Q, E39M/P166S/R217F/G261A/D316L/A368W, E39M/I322M, E39M/T392M, R44L/T47S, R44L/T47S/H92Y/R217F/A271H, R44L/T47S/H92Y/R217F/D316L/I322M/T392M, R44L/T47S/H92Y/T392M, R44L/T47S/P166S, R44L/T47S/P166S/A271H, R44L/T47S/D247N/A271H/T392M, R44L/D316L/I322M/T392M, R44L/P337A, T47S/P166S/A206K/R217F/D247N/P337A, T47S/P166S/R217F/A271H/P337A, T47S/A206K, T47S/R217F/D247N/G261A, T47S/A271H, D52N/R217F/K302Q/D316L, H92Y/P166S/A206K/A271H/D316L, H92Y/P166S/R217F/G261A/A271H/T392M, H92Y/P166S/R217F/D316L/P337A/T392M, H92Y/P166S/D247N, H92Y/P166S/D316L, H92Y/A206K/I322M, H92Y/R217F, H92Y/R217F/A271H/P337A, H92Y/G261A/A271H, H92Y/A271H, P166S/R217F/D316L/I322M/P337A, P166S/D247N/A271H/D316L, P166S/D316L/I322M/P337A, A206K/R217F, R217F/T392M, D247N/D316L, D316L/I322M/A368W, and D316L/P337A/T392M, wherein the amino acid positions of said polypeptide sequence are numbered with reference to SEQ ID NO: 374.

In some embodiments, the recombinant alpha galactosidase A polypeptide sequence has at least 85%, 86%, 87%, 88%, 89%, 90%, 91%, 92%, 93%, 94%, 95%, 96%, 97%, 98%, 99% or more sequence identity to the even-numbered sequences of SEQ ID NOS: 4-702.

In some embodiments, the engineered GLA polypeptide comprises a functional fragment of an engineered GLA polypeptide encompassed by the invention. Functional fragments have at least 80%, 81%, 82%, 83%, 84%, 85%, 86%, 87%, 88%, 89%, 90%, 91%, 92%, 93%, 94%, 95%, 96%, 97%, 98%, or 99% of the activity of the engineered GLA polypeptide from which it was derived (i.e., the parent engineered GLA). A functional fragment comprises at least 80%, 81%, 82%, 83%, 84%, 85%, 86%, 87%, 88%, 89%, 90%, 91%, 92%, 93%, 94%, 95%, 96%, 97%, 98% and even 99% of the parent sequence of the engineered GLA. In some embodiments the functional fragment is truncated by less than 5, less than 10, less than 15, less than 10, less than 25, less than 30, less than 35, less than 40, less than 45, and less than 50 amino acids.

Polynucleotides Encoding Engineered Polypeptides, Expression Vectors and Host Cells:

The present invention provides polynucleotides encoding the engineered GLA polypeptides described herein. In some embodiments, the polynucleotides are operatively linked to one or more heterologous or homologous regulatory sequences that control gene expression to create a recombinant polynucleotide capable of expressing the polypeptide. Expression constructs containing a heterologous polynucleotide encoding the engineered GLA polypeptides can be introduced into appropriate host cells to express the corresponding GLA polypeptide.

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode the engineered GLA polypeptide. Thus, having knowledge of a particular amino acid sequence, those skilled in the art could make any number of different nucleic acids by simply modifying the sequence of one or more codons in a way which does not change the amino acid sequence of the protein. In this regard, the present invention specifically contemplates each and every possible variation of polynucleotides that could be made encoding the polypeptides described herein by selecting combinations based on the possible codon choices, and all such variations are to be considered specifically disclosed for any polypeptide described herein, including the variants provided in Tables 2-1, 5-1, 6-1, 7-1, 8-1, and/or 9-1.

In various embodiments, the codons are preferably selected to fit the host cell in which the protein is being produced. For example, preferred codons used in bacteria are used for expression in bacteria. Consequently, codon optimized polynucleotides encoding the engineered GLA polypeptides contain preferred codons at about 40%, 50%, 60%, 70%, 80%, or greater than 90% of codon positions of the full length coding region. In some embodiments, the present invention provides recombinant polynucleotide sequences in which the codons are optimized for expression in human cells or tissues.

In some embodiments, the present invention provides a recombinant polynucleotide sequence having at least about 85%, about 86%, about 87%, about 88%, about 89%, about 90%, about 91%, about 92%, about 93%, about 94%, about 95%, about 96%, about 97%, about 98%, about 99%, or more sequence identity to SEQ ID NO: 7. In some embodiments, the present invention provides a recombinant polynucleotide sequence having at least 85%, 86%, 87%, 88%, 89%, 90%, 91%, 92%, 93%, 94%, 95%, 96%, 97%, 98%, 99%, or more sequence identity to SEQ ID NO: 7. In some embodiments, the recombinant polynucleotide sequence has at least 85%, 86%, 87%, 88%, 89%, 90%, 91%, 92%, 93%, 94%, 95%, 96%, 97%, 98%, 99% or more sequence identity to the odd-numbered sequences of SEQ ID NOS: 3-701.

In some embodiments, the polynucleotide encodes a recombinant alpha galactosidase A comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 8, or a functional fragment thereof, and wherein said recombinant alpha galactosidase A comprises at least one substitution or substitution set at one or more positions selected from 44, 44/217, 44/217/316, 44/217/322, 44/217/322/337, 44/247, 44/247/302, 44/247/302/322, 44/247/322, 44/247/337, 44/247/362, 44/302, 44/337, 44/373, 217/322, 217/373, 247/322, 247/362, 302/322/362/373, 302/337, 316, 316/337, 322, 322/337, 362/373, and 373, wherein the amino acid positions of said polypeptide sequence are numbered with reference to SEQ ID NO: 8. In some embodiments, the polynucleotide encodes a recombinant alpha galactosidase A comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 8, or a functional fragment thereof, and wherein said recombinant alpha galactosidase A comprises at least one substitution or substitution set at one or more positions selected from 44L, 44L/217F, 44L/217F/316L, 44L/217F/322M, 44L/217F/322M/337A, 44L/247N, 44L/247N/302Q, 44L/247N/302Q/322M, 44L/247N/322M, 44L/247N/337A, 44L/247N/362K, 44L/302Q, 44L/337A, 44L/373R, 217F/322M, 217F/373R, 247N/322M, 247N/362K, 302Q/322M/362K/373R, 302Q/ 337A, 316L, 316L/337A, 322M, 322M/337A, 362K/373R, and 373R, wherein the amino acid positions of said polypeptide sequence are numbered with reference to SEQ ID NO: 8. In some embodiments, the polynucleotide encodes a recombinant alpha galactosidase A comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 8, or a functional fragment thereof, wherein said recombinant alpha galactosidase A comprises at least one substitution or substitution set at one or more positions selected from R44L, R44L/R217F, R44L/ R217F/D316L, R44L/R217F/I322M, R44L/R217F/I322M/ P337A, R44L/D247N, R44L/D247N/K302Q, R44L/ D247N/K302Q/I322M, R44L/D247N/I322M, R44L/ D247N/P337A, R44L/D247N/Q362K, R44L/K302Q, R44L/P337A, R44L/K373R, R217F/I322M, R217F/K373R, D247N/I322M, D247N/Q362K, K302Q/I322M/Q362K/ K373R, K302Q/P337A, D316L, D316L/P337A, I322M, I322M/P337A, Q362K/K373R, and K373R, wherein the amino acid positions of said polypeptide sequence are numbered with reference to SEQ ID NO: 8.

In some embodiments, the polynucleotide encodes a recombinant alpha galactosidase A comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 8, or a functional fragment thereof, and wherein said recombinant alpha galactosidase A comprises at least one substitution or substitution set at one or more positions selected from 10/39/44/47/92/166/206/ 217/247/261/271/302/316/322/337/362/368/373/392, 44/217/316, 44/217/322/337, 166/362, 217/373, and 362/ 373, wherein the amino acid positions of said polypeptide sequence are numbered with reference to SEQ ID NO: 8. In some embodiments, the polynucleotide encodes a recombinant alpha galactosidase A comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 8, or a functional fragment thereof, wherein said recombinant alpha galactosidase A comprises at least one substitution or substitution set at one or more positions selected from 10T/39M/44L/47S/92Y/ 166S/206K/217F/247N/261A/271H/302Q/316L/322M/ 337A/362K/368W/373R/392M, 44L/217F/316L, 44L/ 217F/322M/337A, 166A/362K, 217F/373R, and 362K/ 373R, wherein the amino acid positions of said polypeptide sequence are numbered with reference to SEQ ID NO: 8. In some embodiments, the polynucleotide encodes a recombinant alpha galactosidase A comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 8, or a functional fragment thereof, wherein said recombinant alpha galactosidase A comprises at least one substitution or substitution set at one or more positions selected from P10T/E39M/R44L/T47S/ H92Y/P166S/A206K/R217F/D247N/G261A/A271H/ K302Q/D316L/I322M/P337A/Q362K/A368W/K373R/ T392M, R44L/R217F/D316L, R44L/R217F/I322M/P337A, P166A/Q362K, R217F/K373R, and Q362K/K373R, wherein the amino acid positions of said polypeptide sequence are numbered with reference to SEQ ID NO: 8.

In some embodiments, the present invention provides a recombinant polynucleotide sequence having at least about 85%, about 86%, about 87%, about 88%, about 89%, about 90%, about 91%, about 92%, about 93%, about 94%, about 95%, about 96%, about 97%, about 98%, about 99%, or more sequence identity to SEQ ID NO: 57. In some embodiments, the present invention provides a recombinant polynucleotide sequence having at least 85%, 86%, 87%, 88%, 89%, 90%, 91%, 92%, 93%, 94%, 95%, 96%, 97%, 98%, 99%, or more sequence identity to SEQ ID NO: 57. In some embodiments, the polynucleotide encodes a recombinant alpha galactosidase A, wherein said recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 58, or a functional fragment thereof, and wherein said recombinant alpha galactosidase A comprises at least one substitution or substitution set at one or more positions selected from 7, 7/48/68, 7/48/68/120/282/299, 7/48/130/282, 7/48/180, 7/68/130/282/365, 7/68/180, 7/88/ 120/305/365, 7/120, 7/130, 7/282, 7/305, 7/305/365, 7/365, 39, 47, 47/87/95/96/158/162, 47/95, 47/273, 47/343, 48, 48/68, 48/180/282, 48/282, 48/282/305, 67/180, 68, 68/299/ 300, 71, 87/91/95/96/158/162, 87/91/95/96/206/343, 87/96/ 155/273/343, 88, 91/95, 91/95/96, 92, 93, 96, 96/273, 96/312/343, 120, 120/299/305, 151, 158, 158/162/273, 162, 162/273, 162/343, 166, 178, 180, 181, 206, 217, 271, 273, 273/343, 282, 282/365, 293/391, 299/300, 299/300/305/365, 300, 301, 305, 305/365, 314, 333, 336, 337, 343, 345, 363, 365, 370, 389, 393, 394, 396/398, 397, and 398, wherein the amino acid positions of said polypeptide sequence are numbered with reference to SEQ ID NO: 58. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 58, or a functional fragment thereof, and wherein said recombinant alpha galactosidase A comprises at least one substitution or substitution set at one or more positions selected from 7L, 7L/48D/68E, 7L/48D/68E/120H/282N/ 299R, 7L/48D/130E/282N, 7L/48D/180G, 7L/68E/130E/ 282N/365V, 7L/68E/180G, 7L/88A/120H/305G/365V, 7L/120H, 7L/130E, 7L/282N, 7L/305G, 7L/305G/365V, 7L/365V, 39V, 47D, 47D/87K/95E/96L/158R/162H, 47D/ 95E, 47D/273P, 47D/343G, 47V, 48D, 48D/68E, 48D/180G/ 282N, 48D/282N, 48D/282N/305G, 67T/180G, 68E, 68E/ 299R/300I, 71P, 87K/91Q/95E/96L/158A/162K, 87K/91Q/ 95E/96L/206S/343G, 87K/96I/155N/273P/343G, 88A, 91Q/95E, 91Q/95E/96L, 92F, 92T, 93I, 96L, 96L/273P, 96L/312Q/343G, 120H, 120H/299R/305G, 151L, 158A, 158A/162K/273G, 158R, 162H/343D, 162K, 162K/273P, 162S, 166K, 178G, 178S, 180G, 180L, 180T, 180V, 181A, 206K, 206S, 217K, 271R, 273P, 273P/343G, 282N, 282N/ 365V, 293P/391A, 299R/300I, 299R/300I/305G/365V, 300I, 301M, 305G, 305G/365V, 314A, 333F, 333G, 336V, 337R, 343D, 343G, 345A, 345Q, 363Q, 365A, 365Q, 365V, 370G, 389K, 393V, 394K, 396G/398T, 397A, 398A, 398P, 398S, and 398V, wherein the amino acid positions of said polypeptide sequence are numbered with reference to SEQ ID NO: 58. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 58, or a functional fragment thereof, and wherein said recombinant alpha galactosidase A comprises at least one substitution or substitution set at one or more positions selected from R7L, R7L/E48D/Q68E, R7L/E48D/ Q68E/Y120H/D282N/Q299R, R7L/E48D/D130E/D282N, R7L/E48D/F180G, R7L/Q68E/D130E/D282N/F365V, R7L/Q68E/F180G, R7L/Q88A/Y120H/N305G/F365V, R7L/Y120H, R7L/D130E, R7L/D282N, R7L/N305G, R7L/ N305G/F365V, R7L/F365V, E39V, T47D, T47D/R87K/ S95E/K96L/L158R/R162H, T47D/S95E, T47D/S273P, T47D/K343G, T47V, E48D, E48D/Q68E, E48D/F180G/ D282N, E48D/D282N, E48D/D282N/N305G, P67T/ F180G, Q68E, Q68E/Q299R/L300I, S71P, R87K/N91Q/ S95E/K96L/L158A/R162K, R87K/N91Q/S95E/K96L/ A206S/K343G, R87K/K96I/H155N/S273P/K343G, Q88A, N91Q/S95E, N91Q/S95E/K96L, H92F, H92T, V93I, K96L, K96L/S273P, K96L/P312Q/K343G, Y120H, Y120H/ Q299R/N305G, D151L, L158A, L158A/R162K/S273G, L158R, R162H/K343D, R162K, R162K/S273P, R162S, P166K, W178G, W178S, F180G, F180L, F180T, F180V, Q181A, A206K, A206S, R217K, A271R, S273P, S273P/ K343G, D282N, D282N/F365V, L293P/Q391A, Q299R/ L300I, Q299R/L300I/N305G/F365V, L300I, R301M, N305G, N305G/F365V, S314A, S333F, S333G, I336V, P337R, K343D, K343G, V345A, V345Q, L363Q, F365A, F365Q, F365V, S370G, T389K, S393V, L394K, D396G/ L398T, L397A, L398A, L398P, L398S, and L398V, wherein the amino acid positions of said polypeptide sequence are numbered with reference to SEQ ID NO: 58.

In some embodiments, the present invention provides a recombinant polynucleotide sequence having at least about 85%, about 86%, about 87%, about 88%, about 89%, about 90%, about 91%, about 92%, about 93%, about 94%, about 95%, about 96%, about 97%, about 98%, about 99%, or more sequence identity to SEQ ID NO: 157. In some embodiments, the present invention provides a recombinant polynucleotide sequence having at least 85%, 86%, 87%, 88%, 89%, 90%, 91%, 92%, 93%, 94%, 95%, 96%, 97%, 98%, 99%, or more sequence identity to SEQ ID NO: 157. In some embodiments, the polynucleotide encodes a recombinant alpha galactosidase A, wherein said recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 158, or a functional fragment thereof, and wherein said recombinant alpha galactosidase A comprises at least one substitution or substitution set at one or more positions selected from 24/202, 39/47, 39/47/217, 39/151, 39/282/337/398, 39/337/343/398, 39/393/398, 47/130, 47/151, 47/343/345/393, 48, 48/68, 48/68/217/333/ 391/393, 48/68/333, 48/217, 48/333, 48/345/393, 48/393, 59/143, 68, 68/345, 130, 130/158, 130/158/393, 130/345/ 393, 143/271, 143/333, 143/387, 151, 151/158/217/343/345/ 393, 151/206/282/337/343/345/398, 151/282/393, 151/345/ 393/398, 151/393, 158, 158/393, 202, 206, 206/217, 217, 217/333, 217/337/345/398, 271, 282/393, 333, 333/345, 337/343/345/398, 343, 343/345/393/398, 393, and 393/398, wherein the amino acid positions of said polypeptide sequence are numbered with reference to SEQ ID NO: 158. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 158, or a functional fragment thereof, and wherein recombinant alpha galactosidase A comprises at least one substitution or substitution set at one or more positions selected from 24S/202N, 39V/47D, 39V/47V/217K, 39V/ 151L, 39V/282N/337R/398A, 39V/337R/343G/398A, 39V/ 393V/398A, 47V/130E, 47V/151L, 47V/343D/345Q/393V, 48D, 48D/68E, 48D/68E/217K/333F/391A/393V, 48D/68E/ 333F, 48D/217K, 48D/333F, 48D/333G, 48D/345Q/393V, 48D/393V, 59A/143S, 68E, 68E/345Q, 130E, 130E/158R, 130E/158R/393V, 130E/345Q/393V, 143S/271N, 143S/ 333N, 143S/387N, 151L, 151L/158R/217K/343G/345Q/ 393V, 151L/206S/282N/337R/343D/345Q/398A, 151L/ 282N/393V, 151L/345Q/393V/398A, 151L/393V, 158R, 158R/393V, 202N, 206S, 206S/217K, 217K, 217K/333F, 217K/333G, 217K/337R/345Q/398A, 271N, 282N/393V, 333F/345Q, 333G, 333N, 337R/343G/345Q/398A, 343D, 343D/345Q/393V/398A, 393V, and 393V/398A, wherein the amino acid positions of said polypeptide sequence are numbered with reference to SEQ ID NO: 158. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 8, or a functional fragment thereof, and wherein said recombinant alpha galactosidase A comprises at least one substitution or substitution set at one or more positions selected from D24S/D202N, E39V/T47D, E39V/T47V/R217K, E39V/D151L, E39V/D282N/P337R/L398A, E39V/P337R/ K343G/L398A, E39V/S393V/L398A, T47V/D130E, T47V/ D151L, T47V/K343D/V345Q/S393V, E48D, E48D/Q68E, E48D/Q68E/R217K/S333F/Q391A/S393V, E48D/Q68E/ S333F, E48D/R217K, E48D/S333F, E48D/S333G, E48D/ V345Q/S393V, E48D/S393V, C59A/C143S, Q68E, Q68E/ V345Q, D130E, D130E/L158R, D130E/L158R/S393V, D130E/V345Q/S393V, C143S/A271N, C143S/S333N, C143S/E387N, D151L, D151L/L158R/R217K/K343G/ V345Q/S393V, D151L/A206S/D282N/P337R/K343D/ V345Q/L398A, D151L/D282N/S393V, D151L/V345Q/ S393V/L398A, D151L/S393V, L158R, L158R/S393V, D202N, A206S, A206S/R217K, R217K, R217K/S333F, R217K/S333G, R217K/P337R/V345Q/L398A, A271N, D282N/S393V, S333F/V345Q, S333G, S333N, P337R/ K343G/V345Q/L398A, K343D, K343D/V345Q/S393V/ L398A, S393V, and S393V/L398A, wherein the amino acid positions of said polypeptide sequence are numbered with reference to SEQ ID NO: 158.

In some embodiments, the present invention provides a recombinant polynucleotide sequence having at least about 85%, about 86%, about 87%, about 88%, about 89%, about 90%, about 91%, about 92%, about 93%, about 94%, about 95%, about 96%, about 97%, about 98%, about 99%, or more sequence identity to SEQ ID NO: 371. In some embodiments, the present invention provides a recombinant polynucleotide sequence having at least 85%, 86%, 87%, 88%, 89%, 90%, 91%, 92%, 93%, 94%, 95%, 96%, 97%, 98%, 99%, or more sequence identity to SEQ ID NO: 371. In some embodiments, the polynucleotide encodes a recombinant alpha galactosidase A, wherein said recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 372, or a functional fragment thereof, and wherein said recombinant alpha galactosidase A comprises at least one substitution or substitution set at one or more positions selected from 10, 10/39/44/322, 10/39/ 92/206/217/271, 10/39/92/247, 10/39/92/247/271/316, 10/44, 10/44/47/92/247, 10/44/47/261/302/322/368, 10/44/ 92/316/322, 10/44/261/302/316, 10/44/302/337/368, 10/47/ 217/247/316/392, 10/47/217/322, 10/47/271, 10/92, 10/92/ 206/217/247, 10/92/206/247/316/322/392, 10/92/206/247/ 322/368, 10/92/217/261/302/337, 10/206/217/271, 10/206/ 247, 10/206/261/271/316, 10/261, 10/271/302, 10/302, 10/302/316, 10/302/322/337, 10/316/322, 10/337/392, 10/368, 39/44/92/162/247/302/316/322, 39/44/92/217/322, 39/44/92/247/271/302, 39/47/92/247/302/316/322, 39/47/ 217/247/368, 39/47/247, 39/92/247/302/316/337/368, 39/92/316/322, 39/247/271, 39/247/271/316, 39/322, 44/47/ 92/206/217/316/322, 44/47/92/247/261/271/316/337/368, 44/47/206/217/247/271/322, 44/47/247/322/368, 44/47/ 302/316/322, 44/92/206/247/368, 44/206/337, 44/247/261/ 302/316, 44/247/261/302/316/322, 47/92/247/271, 47/217/

302, 47/247, 47/247/271, 89/217/247/261/302/316, 92/217/271, 92/247, 92/247/271/322, 92/247/302/322/337, 92/271/337, 92/302, 92/316, 206/217/271/392, 217/247/316/322, 217/247/271, 247/302, 271, 271/302/322, 271/316/322, 302/322/368, and 368, wherein the amino acid positions of said polypeptide sequence are numbered with reference to SEQ ID NO: 372. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 372, or a functional fragment thereof, and wherein said recombinant alpha galactosidase A comprises at least one substitution or substitution set at one or more positions selected from 10P, 10P/39E/44R/322I, 10P/39E/92H/206A/217R/271A, 10P/39E/92H/247D, 10P/39E/92H/247D/271A/316D, 10P/44R, 10P/44R/47T/92H/247D, 10P/44R/47T/261G/302K/322I/368A, 10P/44R/92H/316D/322I, 10P/44R/261G/302K/316D, 10P/44R/302K/337P/368A, 10P/47T/217R/247D/316D/392T, 10P/47T/217R/322I, 10P/47T/271A, 10P/92H, 10P/92H/206A/217R/247D, 10P/92H/206A/247D/316D/322I/392T, 10P/92H/206A/247D/322I/368A, 10P/92H/217R/261G/302K/337P, 10P/206A/217R/271A, 10P/206A/247D, 10P/206A/261G/271A/316D, 10P/261G, 10P/271A/302K, 10P/302K, 10P/302K/316D, 10P/302K/322I/337P, 10P/316D/322I, 10P/337P/392T, 10P/368A, 39E/44R/92H/162M/247D/302K/316D/322I, 39E/44R/92H/217R/322I, 39E/44R/92H/247D/271A/302K, 39E/47T/92H/247D/302K/316D/322I, 39E/47T/217R/247D/368A, 39E/47T/247D, 39E/92H/247D/302K/316D/337P/368A, 39E/92H/316D/322I, 39E/247D/271A, 39E/247D/271A/316D, 39E/322I, 44R/47T/92H/206A/217R/316D/322I, 44R/47T/92H/247D/261G/271A/316D/337P/368A, 44R/47T/206A/217R/247D/271A/322I, 44R/47T/247D/322I/368A, 44R/47T/302K/316D/322I, 44R/92H/206A/247D/368A, 44R/206A/337P, 44R/247D/261G/302K/316D, 44R/247D/261G/302K/316D/322I, 47T/92H/247D/271A, 47T/217R/302K, 47T/247D, 47T/247D/271A, 89I/217R/247D/261G/302K/316D, 92H/217R/271A, 92H/247D, 92H/247D/271A/322I, 92H/247D/302K/322I/337P, 92H/271A/337P, 92H/302K, 92H/316D, 206A/217R/271A/392T, 217R/247D/316D/322I/337P/368A, 247D, 247D/271A, 247D/302K, 271A, 271A/302K/322I, 271A/316D/322I, 302K/322I/368A, and 368A, wherein the amino acid positions of said polypeptide sequence are numbered with reference to SEQ ID NO: 372. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 372, or a functional fragment thereof, and wherein said recombinant alpha galactosidase A comprises at least one substitution or substitution set at one or more positions selected from T10P, T10P/M39E/L44R/M322I, T10P/M39E/Y92H/K206A/F217R/H271A, T10P/M39E/Y92H/N247D, T10P/M39E/Y92H/N247D/H271A/L316D, T10P/L44R, T10P/L44R/S47T/Y92H/N247D, T10P/L44R/S47T/A261G/Q302K/M322I/W368A, T10P/L44R/Y92H/L316D/M322I, T10P/L44R/A261G/Q302K/L316D, T10P/L44R/Q302K/A337P/W368A, T10P/S47T/F217R/N247D/L316D/M392T, T10P/S47T/F217R/M322I, T10P/S47T/H271A, T10P/Y92H, T10P/Y92H/K206A/F217R/N247D, T10P/Y92H/K206A/N247D/L316D/M322I/M392T, T10P/Y92H/K206A/N247D/M322I/W368A, T10P/Y92H/F217R/A261G/Q302K/A337P, T10P/K206A/F217R/H271A, T10P/K206A/N247D, T10P/K206A/A261G/H271A/L316D, T10P/A261G, T10P/H271A/Q302K, T10P/Q302K, T10P/Q302K/L316D, T10P/Q302K/M322I/A337P, T10P/L316D/M322I, T10P/A337P/M392T, T10P/W368A, M39E/L44R/Y92H/R162M/N247D/Q302K/L316D/M322I, M39E/L44R/Y92H/F217R/M322I, M39E/L44R/Y92H/N247D/H271A/Q302K, M39E/S47T/Y92H/N247D/Q302K/L316D/M322I, M39E/S47T/F217R/N247D/W368A, M39E/S47T/N247D, M39E/Y92H/N247D/Q302K/L316D/A337P/W368A, M39E/Y92H/L316D/M322I, M39E/N247D/H271A, M39E/N247D/H271A/L316D, M39E/M322I, L44R/S47T/Y92H/K206A/F217R/L316D/M322I, L44R/S47T/Y92H/N247D/A261G/H271A/L316D/A337P/W368A, L44R/S47T/K206A/F217R/N247D/H271A/M322I, L44R/S47T/N247D/M322I/W368A, L44R/S47T/Q302K/L316D/M322I, L44R/Y92H/K206A/N247D/W368A, L44R/K206A/A337P, L44R/N247D/A261G/Q302K/L316D, L44R/N247D/A261G/Q302K/L316D/M322I, S47T/Y92H/N247D/H271A, S47T/F217R/Q302K, S47T/N247D, S47T/N247D/H271A, L89I/F217R/N247D/A261G/Q302K/L316D, Y92H/F217R/H271A, Y92H/N247D, Y92H/N247D/H271A/M322I, Y92H/N247D/Q302K/M322I/A337P, Y92H/H271A/A337P, Y92H/Q302K, Y92H/L316D, K206A/F217R/H271A/M392T, F217R/N247D/L316D/M322I/A337P/W368A, N247D, N247D/H271A, N247D/Q302K, H271A, H271A/Q302K/M322I, H271A/L316D/M322I, Q302K/M322I/W368A, and W368A, wherein the amino acid positions of said polypeptide sequence are numbered with reference to SEQ ID NO: 372.

In some embodiments, the present invention provides a recombinant polynucleotide sequence having at least about 85%, about 86%, about 87%, about 88%, about 89%, about 90%, about 91%, about 92%, about 93%, about 94%, about 95%, about 96%, about 97%, about 98%, about 99%, or more sequence identity to SEQ ID NO: 373. In some embodiments, the present invention provides a recombinant polynucleotide sequence having at least 85%, 86%, 87%, 88%, 89%, 90%, 91%, 92%, 93%, 94%, 95%, 96%, 97%, 98%, 99%, or more sequence identity to SEQ ID NO: 373. In some embodiments, the polynucleotide encodes a recombinant alpha galactosidase A, wherein said recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 374, or a functional fragment thereof, and wherein said recombinant alpha galactosidase A comprises at least one substitution or substitution set at one or more positions selected from 10/36/92/166/247/261/316/392, 10/39, 10/39/44/47/92/206/217, 10/39/44/47/316, 10/39/44/47/337, 10/39/44/92/166/261/316/322, 10/39/44/92/166/302/322, 10/39/44/92/166/392, 10/39/44/92/217/302/322, 10/39/44/92/302/322, 10/39/44/166/261/271/316/322, 10/39/44/392, 10/39/47/92/337, 10/39/92/131/166/271/316/322, 10/39/92/166/217/247/271, 10/39/92/217/316, 10/44/47/166/261/271, 10/44/47/166/271/322/368, 10/44/47/217/271/316/322, 10/44/92, 10/44/92/217/247/271/302/316/392, 10/44/166/302, 10/44/206/316/322, 10/47/92/166/271/316/337, 10/47/92/271/302, 10/47/92/316/322/392, 10/47/166/271, 10/47/166/316, 10/92/166, 10/92/166/217/247/261/271, 10/92/166/261/271/392, 10/92/166/261/316/322/337, 10/92/166/337/368, 10/92/302/337, 10/92/316/322, 10/206, 10/206/247/261, 10/217/322, 10/261, 10/261/337/392, 10/316/392, 10/368, 39/44/47/92/166/206/392, 39/44/47/92/206/247/261, 39/44/47/92/206/392, 39/44/47/206/337/368/392, 39/44/92/166/247/261/302/337, 39/44/166/271, 39/44/166/271/337/368/392, 39/47/92/316/322, 39/47/92/392, 39/47/166/217/261/392, 39/47/217/247/368, 39/47/247, 39/92/166/217/392, 39/92/166/217/261/302, 39/166/217/261/316/368, 39/322, 39/392, 44/47, 44/47/92/217/271, 44/47/92/217/316/322/392, 44/47/92/392, 44/47/166, 44/47/ 166/271, 44/47/247/271/392, 44/316/322/392, 44/337, 47/166/206/217/247/337, 47/166/217/271/337, 47/206, 47/217/247/261, 47/271, 52/217/302/316, 92/166/206/271/ 316, 92/166/217/261/271/392, 92/166/217/316/337/392, 92/166/247, 92/166/316, 92/206/322, 92/217, 92/217/271/ 337, 92/261/271, 92/271, 166/217/316/322/337, 166/247/ 271/316, 166/316/322/337, 206/217, 217/392, 247/316, 316/ 322/368, and 316/337/392, wherein the amino acid positions of said polypeptide sequence are numbered with reference to SEQ ID NO: 374. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 374, or a functional fragment thereof, and wherein said recombinant alpha galactosidase A comprises at least one substitution or substitution set at one or more positions selected from 10T/36M/92Y/166S/247N/ 261A/316L/392M, 10T/39M, 10T/39M/44L/47S/92Y/ 206K/217F, 10T/39M/44L/47S/316L, 10T/39M/44L/47S/ 337A, 10T/39M/44L/92Y/166S/261A/316L/322M, 10T/ 39M/44L/92Y/166S/302Q/322M, 10T/39M/44L/92Y/ 166S/392M, 10T/39M/44L/92Y/217F/302Q/322M, 10T/ 39M/44L/92Y/302Q/322M, 10T/39M/44L/166S/261A/ 271H/316L/322M, 10T/39M/44L/392M, 10T/39M/47S/ 92Y/337A, 10T/39M/92Y/131G/166S/271H/316L/322M, 10T/39M/92Y/166S/217F/247N/271H, 10T/39M/92Y/ 217F/316L, 10T/44L/47S/166S/261A/271H, 10T/44L/47S/ 166S/271H/322M/368W, 10T/44L/47S/217F/271H/316L/ 322M, 10T/44L/92Y, 10T/44L/92Y/217F/247N/271H/ 302Q/316L/392M, 10T/44L/166S/302Q, 10T/44L/206K/ 316L/322M, 10T/47S/92Y/166S/271H/316L/337A, 10T/ 47S/92Y/271H/302Q, 10T/47S/92Y/316L/322M/392M, 10T/47S/166S/271H, 10T/47S/166S/316L, 10T/92Y/166S, 10T/92Y/166S/217F/247N/261A/271H, 10T/92Y/166S/ 261A/271H/392M, 10T/92Y/166S/261A/316L/322M/ 337A, 10T/92Y/166S/337A/368W, 10T/92Y/302Q/337A, 10T/92Y/316L/322M, 10T/206K, 10T/206K/247N/261A, 10T/217F/322M, 10T/261A, 10T/261A/337A/392M, 10T/ 316L/392M, 10T/368W, 39M/44L/47S/92Y/166S/206K/ 392M, 39M/44L/47S/92Y/206K/247N/261A, 39M/44L/ 47S/92Y/206K/392M, 39M/44L/47S/206K/337A/368W/ 392M, 39M/44L/92Y/166S/247N/261A/302Q/337A, 39M/ 44L/166S/271H, 39M/44L/166S/271H/337A/368W/392M, 39M/47S/92Y/316L/322M, 39M/47S/92Y/392M, 39M/ 47S/166S/217F/261A/392M, 39M/47S/217F/247N/368W, 39M/47S/247N, 39M/92Y/166S/217F/392M, 39M/92Y/ 261A/302Q, 39M/166S/217F/261A/316L/368W, 39M/ 322M, 39M/392M, 44L/47S, 44L/47S/92Y/217F/271H, 44L/47S/92Y/217F/316L/322M/392M, 44L/47S/92Y/ 392M, 44L/47S/166S, 44L/47S/166S/271H, 44L/47S/ 247N/271H/392M, 44L/316L/322M/392M, 44L/337A, 47S/166S/206K/217F/247N/337A, 47S/166S/217F/271H/ 337A, 47S/206K, 47S/217F/247N/261A, 47S/271H, 52N/ 217F/302Q/316L, 92Y/166S/206K/271H/316L, 92Y/166S/ 217F/261A/271H/392M, 92Y/166S/217F/316L/337A/ 392M, 92Y/166S/247N, 92Y/166S/316L, 92Y/206K/322M, 92Y/217F, 92Y/217F/271H/337A, 92Y/261A/271H, 92Y/ 271H, 166S/217F/316L/322M/337A, 166S/247N/271H/ 316L, 166S/316L/322M/337A, 206K/217F, 217F/392M, 247N/316L, 316L/322M/368W, and 316L/337A/392M, wherein the amino acid positions of said polypeptide sequence are numbered with reference to SEQ ID NO: 374. In some embodiments, the recombinant alpha galactosidase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 374, or a functional fragment thereof, and wherein said recombinant alpha galactosidase A comprises at least one substitution or substitution set at one or more positions selected from P10T/K36M/H92Y/P166S/D247N/G261A/ D316L/T392M, P10T/E39M, P10T/E39M/R44L/T47S/ H92Y/A206K/R217F, P10T/E39M/R44L/T47S/D316L, P10T/E39M/R44L/T47S/P337A, P10T/E39M/R44L/H92Y/ P166S/G261A/D316L/I322M, P10T/E39M/R44L/H92Y/ P166S/K302Q/I322M, P10T/E39M/R44L/H92Y/P166S/ T392M, P10T/E39M/R44L/H92Y/R217F/K302Q/I322M, P10T/E39M/R44L/H92Y/K302Q/I322M, P10T/E39M/ R44L/P166S/G261A/A271H/D316L/I322M, P10T/E39M/ R44L/T392M, P10T/E39M/T47S/H92Y/P337A, P10T/ E39M/H92Y/W131G/P166S/A271H/D316L/I322M, P10T/ E39M/H92Y/P166S/R217F/D247N/A271H, P10T/E39M/ H92Y/R217F/D316L, P10T/R44L/T47S/P166S/G261A/ A271H, P10T/R44L/T47S/P166S/A271H/I322M/A368W, P10T/R44L/T47S/R217F/A271H/D316L/I322M, P10T/ R44L/H92Y, P10T/R44L/H92Y/R217F/D247N/A271H/ K302Q/D316L/T392M, P10T/R44L/P166S/K302Q, P10T/ R44L/A206K/D316L/I322M, P10T/T47S/H92Y/P166S/ A271H/D316L/P337A, P10T/T47S/H92Y/A271H/K302Q, P10T/T47S/H92Y/D316L/I322M/T392M, P10T/T47S/ P166S/A271H, P10T/T47S/P166S/D316L, P10T/H92Y/ P166S, P10T/H92Y/P166S/R217F/D247N/G261A/A271H, P10T/H92Y/P166S/G261A/A271H/T392M, P10T/H92Y/ P166S/G261A/D316L/I322M/P337A, P10T/H92Y/P166S/ P337A/A368W, P10T/H92Y/K302Q/P337A, P10T/H92Y/ D316L/I322M, P10T/A206K, P10T/A206K/D247N/ G261A, P10T/R217F/I322M, P10T/G261A, P10T/G261A/ P337A/T392M, P10T/D316L/T392M, P10T/A368W, E39M/R44L/T47S/H92Y/P166S/A206K/T392M, E39M/ R44L/T47S/H92Y/A206K/D247N/G261A, E39M/R44L/ T47S/H92Y/A206K/T392M, E39M/R44L/T47S/A206K/ P337A/A368W/T392M, E39M/R44L/H92Y/P166S/ D247N/G261A/K302Q/P337A, E39M/R44L/P166S/ A271H, E39M/R44L/P166S/A271H/P337A/A368W/ T392M, E39M/T47S/H92Y/D316L/I322M, E39M/T47S/ H92Y/T392M, E39M/T47S/P166S/R217F/G261A/T392M, E39M/T47S/R217F/D247N/A368W, E39M/T47S/D247N, E39M/H92Y/P166S/R217F/T392M, E39M/H92Y/G261A/ K302Q, E39M/P166S/R217F/G261A/D316L/A368W, E39M/I322M, E39M/T392M, R44L/T47S, R44L/T47S/ H92Y/R217F/A271H, R44L/T47S/H92Y/R217F/D316L/ I322M/T392M, R44L/T47S/H92Y/T392M, R44L/T47S/ P166S, R44L/T47S/P166S/A271H, R44L/T47S/D247N/ A271H/T392M, R44L/D316L/I322M/T392M, R44L/ P337A, T47S/P166S/A206K/R217F/D247N/P337A, T47S/ P166S/R217F/A271H/P337A, T47S/A206K, T47S/R217F/ D247N/G261A, T47S/A271H, D52N/R217F/K302Q/ D316L, H92Y/P166S/A206K/A271H/D316L, H92Y/ P166S/R217F/G261A/A271H/T392M, H92Y/P166S/ R217F/D316L/P337A/T392M, H92Y/P166S/D247N, H92Y/P166S/D316L, H92Y/A206K/I322M, H92Y/R217F, H92Y/R217F/A271H/P337A, H92Y/G261A/A271H, H92Y/A271H, P166S/R217F/D316L/I322M/P337A, P166S/D247N/A271H/D316L, P166S/D316L/I322M/ P337A, A206K/R217F, R217F/T392M, D247N/D316L, D316L/I322M/A368W, and D316L/P337A/T392M, wherein the amino acid positions of said polypeptide sequence are numbered with reference to SEQ ID NO: 374.

In some embodiments, as described above, the polynucleotide encodes an engineered polypeptide having GLA activity with the properties disclosed herein, wherein the polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or more identity to a reference sequence (e.g., SEQ ID NO: 2, 8, 58, 158, 372, and/or 374), or the amino acid sequence of any variant as disclosed in Table 2.1 and/or 5.1, and one or more residue differences as compared to the reference polypeptide of SEQ ID NO: 8, or the amino acid sequence of any variant as disclosed in Table 2-1, 5-1, 6-1, 7-1, 8-1, and/or 9-1 (for example 1, 2, 3, 4, 5, 6, 7, 8, 9, 10 or more amino acid residue positions). In some embodiments, the polynucleotide encodes an engineered polypeptide having GLA activity with the properties disclosed herein, wherein the polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or more sequence identity to reference sequence SEQ ID NO: 2, 8, 58, 158, 372, and/or 374, and one or more residue differences as compared to SEQ ID NO: 2, 8, 58, 158, 372, and/or 374, at residue positions selected from those provided in Table 2-1, 5-1, 6-1, 7-1, 8-1, and/or 9-1, when optimally aligned with the polypeptide of SEQ ID NO: 8, 58, 158, 372, and/or 374.

In some embodiments, the polynucleotide encoding the engineered GLA polypeptides comprises the polynucleotide sequence of SEQ ID NO: 8, 58, 158, 372, and/or 374. In some embodiments, the polynucleotides are capable of hybridizing under highly stringent conditions to a reference polynucleotide sequence. In some embodiments, the reference sequence is selected from SEQ ID NOS: 1, 7, 57, 157, 371, and/or 373, or a complement thereof, or a polynucleotide sequence encoding any of the variant GLA polypeptides provided herein. In some embodiments, the polynucleotide capable of hybridizing under highly stringent conditions encodes a GLA polypeptide comprising an amino acid sequence that has one or more residue differences as compared to SEQ ID NO: 2, 8, 58, 158, 372, and/or 374, at residue positions selected from any positions as set forth in Table 2-1, 5-1, 6-1, 7-1, 8-1, and/or 9-1.

In some embodiments, an isolated polynucleotide encoding any of the engineered GLA polypeptides provided herein is manipulated in a variety of ways to provide for expression of the polypeptide. In some embodiments, the polynucleotides encoding the polypeptides are provided as expression vectors where one or more control sequences is present to regulate the expression of the polynucleotides and/or polypeptides. Manipulation of the isolated polynucleotide prior to its insertion into a vector may be desirable or necessary depending on the expression vector. The techniques for modifying polynucleotides and nucleic acid sequences utilizing recombinant DNA methods are well known in the art.

In some embodiments, the control sequences include among other sequences, promoters, Kozak sequence, leader sequences, polyadenylation sequences, propeptide sequences, signal peptide sequences, DNA based regulatory elements for gene therapy retention and transcription terminators. As known in the art, suitable promoters can be selected based on the host cells used. Exemplary promoters for filamentous fungal host cells, include promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are known in the art (See e.g., Romanos et al., Yeast 8:423-488 [1992]). Exemplary promoters for use in mammalian cells include, but are not limited to those from cytomegalovirus (CMV), chicken β-actin promoter fused with the CMV enhancer, Simian vacuolating virus 40 (SV40), from *Homo sapiens* phosphorglycerate kinase, beta actin, elongation factor-1a or glyceraldehyde-3-phosphate dehydrogenase, or from *Gallus gallus* β-actin.

In some embodiments, the control sequence is a suitable transcription terminator sequence, a sequence recognized by a host cell to terminate transcription. The terminator sequence is operably linked to the 3' terminus of the nucleic acid sequence encoding the polypeptide. Any terminator which is functional in the host cell of choice finds use in the present invention. For example, exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are known in the art (See e.g., Romanos et al., supra). Exemplary terminators for mammalian cells include, but are not limited to those from cytomegalovirus (CMV), Simian vacuolating virus 40 (SV40), from *Homo sapiens* growth hormone hGH, from bovine growth hormone BGH, and from human or rabbit beta globulin.

In some embodiments, the control sequence is a suitable leader sequence, 5'-cap modification, 5' UTR, etc. In some embodiments, these regulatory sequence elements mediate binding to molecules involved in mRNA trafficking and translation, inhibit 5'-exonucleolytic degradation and confer resistance to de-capping. The leader sequence is operably linked to the 5' terminus of the nucleic acid sequence encoding the polypeptide. Any leader sequence that is functional in the host cell of choice may be used. Exemplary leaders for filamentous fungal host cells are obtained from the genes for *Aspergillus oryzae* TAKA amylase and *Aspergillus nidulans* triose phosphate isomerase. Suitable leaders for yeast host cells include, but are not limited to those obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP). Suitable leaders for mammalian host cells include but are not limited to the 5'-UTR element present in orthopoxvirus mRNA.

In some embodiments, the control sequence comprises a 3' untranslated nucleic acid region and polyadenylation tail nucleic acid sequence, sequences operably linked to the 3' terminus of the protein coding nucleic acid sequence which mediate binding to proteins involved in mRNA trafficking and translation and mRNA half-life. Any polyadenylation sequence and 3' UTR which is functional in the host cell of choice may be used in the present invention. Exemplary polyadenylation sequences for filamentous fungal host cells include, but are not limited to those from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are also known in the art (See e.g., Guo and Sherman, Mol. Cell. Biol., 15:5983-5990 [1995]). Useful polyadenylation and 3' UTR sequences for mammalian host cells include, but are not limited to the 3'-UTRs of α- and β-globin mRNAs that harbor several sequence elements that increase the stability and translation of mRNA.

In some embodiments, the control sequence is a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. Any signal peptide coding region that directs the expressed polypeptide into the secretory pathway of a host cell of choice finds use for expression of the engineered GLA polypeptides provided herein. Effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells include, but are not limited to those from the genes for *Saccharomyces cerevisiae* alpha-factor and *Saccharomyces cerevisiae* invertase. Useful signal peptides for mammalian host cells include but are not limited to those from the genes for immunoglobulin gamma (IgG).

In some embodiments, the control sequence is a propeptide coding region that codes for an amino acid sequence positioned at the amino terminus of a polypeptide. The resultant polypeptide is referred to as a "proenzyme," "propolypeptide," or "zymogen," in some cases). A propolypeptide can be converted to a mature active polypeptide by catalytic or autocatalytic cleavage of the propeptide from the propolypeptide.

In another aspect, the present invention also provides a recombinant expression vector comprising a polynucleotide encoding an engineered GLA polypeptide, and one or more expression regulating regions such as a promoter and a terminator, a replication origin, etc., depending on the type of hosts into which they are to be introduced. in some embodiments, the various nucleic acid and control sequences described above are joined together to produce a recombinant expression vector which includes one or more convenient restriction sites to allow for insertion or substitution of the nucleic acid sequence encoding the variant GLA polypeptide at such sites. Alternatively, the polynucleotide sequence(s) of the present invention are expressed by inserting the polynucleotide sequence or a nucleic acid construct comprising the polynucleotide sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus including but not limited to adenovirus (AV), adeno-associated virus (AAV), lentivirus (LV), and non-viral vectors, such as liposomes), that can be conveniently subjected to recombinant DNA procedures and can result in the expression of the variant GLA polynucleotide sequence. The choice of the vector will typically depend on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

In some embodiments, the expression vector preferably contains one or more selectable markers, which permit easy selection of transformed cells. A "selectable marker" is a gene the product of which provides for biocide or viral resistance, resistance to heavy metals, prototrophy to auxotrophs, and the like. Suitable markers for yeast host cells include, but are not limited to ADE2, HIS3, LEU2, LYS2, MET3, TRP1, and URA3. Selectable markers for use in a filamentous fungal host cell include, but are not limited to, amdS (acetamidase), argB (ornithine carbamoyltransferases), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. In another aspect, the present invention provides a host cell comprising a polynucleotide encoding at least one engineered GLA polypeptide of the present application, the polynucleotide being operatively linked to one or more control sequences for expression of the engineered GLA enzyme(s) in the host cell. Host cells for use in expressing the polypeptides encoded by the expression vectors of the present invention are well known in the art and include but are not limited to, fungal cells, such as yeast cells (e.g., *Saccharomyces cerevisiae* and *Pichia pastoris* [e.g., ATCC Accession No. 201178]); insect cells (e.g., *Drosophila* S2 and *Spodoptera* Sf9 cells), plant cells, animal cells (e.g., CHO, CHO-K1, COS, and BHK), and human cells (e.g., HEK293T, human fibroblast, THP-1, Jurkat and Bowes melanoma cell lines).

Accordingly, in another aspect, the present invention provides methods for producing the engineered GLA polypeptides, where the methods comprise culturing a host cell capable of expressing a polynucleotide encoding the engineered GLA polypeptide under conditions suitable for expression of the polypeptide. In some embodiments, the methods further comprise the steps of isolating and/or purifying the GLA polypeptides, as described herein.

Appropriate culture media and growth conditions for the above-described host cells are well known in the art. Polynucleotides for expression of the GLA polypeptides may be introduced into cells by various methods known in the art. Techniques include, among others, electroporation, biolistic particle bombardment, liposome mediated transfection, calcium chloride transfection, and protoplast fusion.

The engineered GLA with the properties disclosed herein can be obtained by subjecting the polynucleotide encoding the naturally occurring or engineered GLA polypeptide to mutagenesis and/or directed evolution methods known in the art, and as described herein. An exemplary directed evolution technique is mutagenesis and/or DNA shuffling (See e.g., Stemmer, Proc. Natl. Acad. Sci. USA 91:10747-10751 [1994]; WO 95/22625; WO 97/0078; WO 97/35966; WO 98/27230; WO 00/42651; WO 01/75767 and U.S. Pat. No. 6,537,746). Other directed evolution procedures that can be used include, among others, staggered extension process (StEP), in vitro recombination (See e.g., Zhao et al., Nat. Biotechnol., 16:258-261 [1998]), mutagenic PCR (See e.g., Caldwell et al., PCR Methods Appl., 3:S136-S140 [1994]), and cassette mutagenesis (See e.g., Black et al., Proc. Natl. Acad. Sci. USA 93:3525-3529 [1996]).

For example, mutagenesis and directed evolution methods can be readily applied to polynucleotides to generate variant libraries that can be expressed, screened, and assayed. Mutagenesis and directed evolution methods are well known in the art (See e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,489,146, 6,506,602, 6,506,603, 6,519,065, 6,521,453, 6,528,311, 6,537,746, 6,573,098, 6,576,467, 6,579,678, 6,586,182, 6,602,986, 6,613,514, 6,653,072, 6,716,631, 6,946,296, 6,961,664, 6,995,017, 7,024,312, 7,058,515, 7,105,297, 7,148,054, 7,288,375, 7,421,347, 7,430,477, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,873,499, 7,904,249, 7,957,912, 8,383,346, 8,504,498, 8,849,575, 8,876,066, 8,768,871, 9,593,326, and all related non-US counterparts; Ling et al., Anal. Biochem., 254(2):157-78 [1997]; Dale et al., Meth. Mol. Biol., 57:369-74 [1996]; Smith, Ann. Rev. Genet., 19:423-462 [1985]; Botstein et al., Science, 229: 1193-1201 [1985]; Carter, Biochem. J., 237:1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391:288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; US Pat. Appln. Publn. Nos. 2008/0220990, US 2009/0312196, US2014/0005057, US2014/0214391, US2014/0221216; US2015/0050658, US2015/0133307, US2015/0134315 and all related non-US counterparts; WO 95/22625, WO 97/0078, WO 97/35966, WO 98/27230, WO 00/42651, WO 01/75767, and WO 2009/152336; all of which are incorporated herein by reference).

In some embodiments, the enzyme variants obtained following mutagenesis treatment are screened by subjecting the enzyme variants to a defined temperature (or other assay conditions) and measuring the amount of enzyme activity remaining after heat treatments or other assay conditions. DNA containing the polynucleotide encoding the GLA polypeptide is then isolated from the host cell, sequenced to identify the nucleotide sequence changes (if any), and used to express the enzyme in a different or the same host cell. Measuring enzyme activity from the expression libraries can be performed using any suitable method known in the art (e.g., standard biochemistry techniques, such as HPLC analysis).

For engineered polypeptides of known sequence, the polynucleotides encoding the enzyme can be prepared by standard solid-phase methods, according to known synthetic methods. In some embodiments, fragments of up to about 100 bases can be individually synthesized, then joined (e.g., by enzymatic or chemical litigation methods, or polymerase mediated methods) to form any desired continuous sequence. For example, polynucleotides and oligonucleotides disclosed herein can be prepared by chemical synthesis using the classical phosphoramidite method (See e.g., Beaucage et al., Tetra. Lett., 22:1859-69 [1981]; and Matthes et al., EMBO J., 3:801-05 [1984]), as it is typically practiced in automated synthetic methods. According to the phosphoramidite method, oligonucleotides are synthesized (e.g., in an automatic DNA synthesizer), purified, annealed, ligated and cloned in appropriate vectors.

Accordingly, in some embodiments, a method for preparing the engineered GLA polypeptide can comprise: (a) synthesizing a polynucleotide encoding a polypeptide comprising an amino acid sequence selected from the amino acid sequence of any variant provided in Table 2-1, 5-1, 6-1, 7-1, 8-1, and/or 9-1, as well as SEQ ID NOS: 8, 58, 158, 372, and/or 374, and (b) expressing the GLA polypeptide encoded by the polynucleotide. In some embodiments of the method, the amino acid sequence encoded by the polynucleotide can optionally have one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions can be conservative or non-conservative substitutions.

The expressed engineered GLA polypeptide can be assessed for any desired improved property (e.g., activity, selectivity, stability, acid tolerance, protease sensitivity, etc.), using any suitable assay known in the art, including but not limited to the assays and conditions described herein.

In some embodiments, any of the engineered GLA polypeptides expressed in a host cell are recovered from the cells and/or the culture medium using any one or more of the well-known techniques for protein purification, including, among others, lysozyme treatment, sonication, filtration, salting-out, ultra-centrifugation, and chromatography.

Chromatographic techniques for isolation of the GLA polypeptides include, among others, reverse phase chromatography high performance liquid chromatography, ion exchange chromatography, hydrophobic interaction chromatography, gel electrophoresis, and affinity chromatography. Conditions for purifying a particular enzyme depends, in part, on factors such as net charge, hydrophobicity, hydrophilicity, molecular weight, molecular shape, etc., and will be apparent to those having skill in the art. In some embodiments, affinity techniques may be used to isolate the improved variant GLA enzymes. In some embodiments utilizing affinity chromatography purification, any antibody which specifically binds the variant GLA polypeptide finds use. In some embodiments utilizing affinity chromatography purification, proteins that bind to the glycans covalently attached to GLA find use. In still other embodiments utilizing affinity-chromatography purifications, any small molecule that binds to the GLA active site finds use. For the production of antibodies, various host animals, including but not limited to rabbits, mice, rats, etc., are immunized by injection with a GLA polypeptide (e.g., a GLA variant), or a fragment thereof. In some embodiments, the GLA polypeptide or fragment is attached to a suitable carrier, such as BSA, by means of a side chain functional group or linkers attached to a side chain functional group.

In some embodiments, the engineered GLA polypeptide is produced in a host cell by a method comprising culturing a host cell (e.g., *S. cerevisiae, Daucus carota, Nicotiana tabacum, H. sapiens* (e.g., HEK293T), or *Cricetulus griseus* (e.g., CHO)) comprising a polynucleotide sequence encoding an engineered GLA polypeptide as described herein under conditions conducive to the production of the engineered GLA polypeptide and recovering the engineered GLA polypeptide from the cells and/or culture medium.

In some embodiments, the invention encompasses a method of producing an engineered GLA polypeptide comprising culturing a recombinant eukaryotic cell comprising a polynucleotide sequence encoding an engineered GLA polypeptide having at least 80%, 81%, 82%, 83%, 84%, 85%, 86%, 87%, 88%, 89%, 90%, 95%, 96%, 97%, 98%, 99%, or 100% sequence identity to a reference sequence (e.g., SEQ ID NO: 8, 58, 158, 372, and/or 374), and one or more amino acid residue differences as compared to SEQ ID NO: 8, selected from those provided in Tables 2-1, 5-1, 6-1, 7-1, 8-1, 9-1, and/or combinations thereof when optimally aligned with the amino acid sequence of SEQ ID NO:8, 58, 158, 372, and/or 374, under suitable culture conditions to allow the production of the engineered GLA polypeptide and optionally recovering the engineered GLA polypeptide from the culture and/or cultured cells.

In some embodiments, once the engineered GLA polypeptides are recovered from the recombinant host cells or cell culture medium, they are further purified by any suitable method(s) known in the art. In some additional embodiments, the purified GLA polypeptides are combined with other ingredients and compounds to provide compositions and formulations comprising the engineered GLA polypeptide as appropriate for different applications and uses (e.g., pharmaceutical compositions). In some additional embodiments, the purified engineered GLA polypeptides, or the formulated engineered GLA polypeptides are lyophilized. In some embodiments, the engineered GLA polypeptides are directly produced within a body (i.e., cells within a body, such as a human or another animal) and are not purified. However, in some alternative embodiments, the engineered GLA polypeptides are produced within a body (i.e., cells within a body, such as a human or another animal) and are collected from the body using methods known in the art. In some additional embodiments, these collected engineered GLA polypeptides are purified. In yet some further embodiments, these collected and/or purified engineered polypeptides are introduced into another animal (e.g., human or another animal) or reintroduced into the body that originally produced the collected and/or purified engineered GLA polypeptides.

Compositions:

The present invention provides various compositions and formats, including but not limited to those described below. In some embodiments, the present invention provides engineered GLA polypeptides suitable for use in pharmaceutical and other compositions, such as dietary/nutritional supplements.

Depending on the mode of administration, these compositions comprising a therapeutically effective amount of an engineered GLA according to the invention are in the form of a solid, semi-solid, or liquid. In some embodiments, the compositions include other pharmaceutically acceptable components such as diluents, buffers, excipients, salts, emulsifiers, preservatives, stabilizers, fillers, and other ingredients. Details on techniques for formulation and administration are well known in the art and described in the literature. In some embodiments, these compositions are produced directly in the human body after introduction as gene therapy.

In some embodiments, the engineered GLA polypeptides are formulated for use in pharmaceutical compositions. Any suitable format for use in delivering the engineered GLA polypeptides find use in the present invention, including but not limited to pills, tablets, gel tabs, capsules, lozenges, dragees, powders, soft gels, sol-gels, gels, emulsions, implants, patches, sprays, ointments, liniments, creams, pastes, jellies, paints, aerosols, chewing gums, demulcents, sticks, solutions, suspensions (including but not limited to oil-based suspensions, oil-in water emulsions, etc.), slurries, syrups, controlled release formulations, suppositories, etc. In some embodiments, the engineered GLA polypeptides are provided in a format suitable for injection or infusion (i.e., in an injectable formulation). In some embodiments, the polynucleotide sequences for the engineered GLA polypeptide is provided in a format suitable for injection. In some embodiments, the engineered GLA polypeptides are provided in biocompatible matrices such as sol-gels, including silica-based (e.g., oxysilane) sol-gels. In some embodiments, the engineered GLA polypeptides are encapsulated. In some alternative embodiments, the engineered GLA polypeptides are encapsulated in nanostructures (e.g., nanotubes, nanotubules, nanocapsules, or microcapsules, microspheres, liposomes, etc.). Indeed, it is not intended that the present invention be limited to any particular delivery formulation and/or means of delivery. It is intended that the engineered GLA polypeptides be administered by any suitable means known in the art, including but not limited to parenteral, oral, topical, transdermal, intranasal, intraocular, intrathecal, via implants, etc.

In some embodiments, the engineered GLA polypeptides are chemically modified by glycosylation, chemical crosslinking reagents, pegylation (i.e., modified with polyethylene glycol [PEG] or activated PEG, etc.) or other compounds (See e.g., Ikeda, Amino Acids 29:283-287 [2005]; U.S. Pat. Nos. 7,531,341, 7,534,595, 7,560,263, and 7,53,653; US Pat. Appln. Publ. Nos. 2013/0039898, 2012/0177722, etc.). Indeed, it is not intended that the present invention be limited to any particular delivery method and/or mechanism.

In some additional embodiments, the engineered GLA polypeptides are provided for delivery to cells or tissues via gene therapy, including viral delivery vectors, including but not limited to adenovirus (AV), adeno-associated virus (AAV), lentivirus (LV), or non-viral vectors (e.g., liposomes). In some embodiments, the engineered GLA polypeptides are provided for delivery to cells or tissues via mRNA therapy following formulation of polyribonucleotide sequences in a encapsulated delivery, such as liposomes. In some additional embodiments, the engineered GLA polypeptides are provided for delivery to cells or tissues via cell therapy, where the polynucleotide sequence encoding the engineered GLA polypeptides is introduced into exogenous cell and that cell (or cells) are introduced into a recipient (e.g., a patient exhibiting or at risk for developing Fabry disease).

In some additional embodiments, the engineered GLA polypeptides are provided in formulations comprising matrix-stabilized enzyme crystals. In some embodiments, the formulation comprises a cross-linked crystalline engineered GLA enzyme and a polymer with a reactive moiety that adheres to the enzyme crystals. The present invention also provides engineered GLA polypeptides in polymers.

In some embodiments, compositions comprising the engineered GLA polypeptides of the present invention include one or more commonly used carrier compounds, including but not limited to sugars (e.g., lactose, sucrose, mannitol, and/or sorbitol), starches (e.g., corn, wheat, rice, potato, or other plant starch), cellulose (e.g., methyl cellulose, hydroxypropylmethyl cellulose, sodium carboxy-methylcellulose), gums (e.g., arabic, tragacanth, guar, etc.), and/or proteins (e.g., gelatin, collagen, etc.).

In some embodiments, the present invention provides engineered GLA polypeptides suitable for use in decreasing the concentration of glycolipids in fluids such as blood, cerebrospinal fluid, etc. The dosage of engineered GLA polypeptide(s) administered depends upon the condition or disease, the general condition of the subject, and other factors known to those in the art. In some embodiments, the compositions are intended for single or multiple administrations. In some embodiments, it is contemplated that the concentration of engineered GLA polypeptide(s) in the composition(s) administered to a human with Fabry disease is sufficient to effectively treat, and/or ameliorate disease (e.g., Fabry disease). In some embodiments, the engineered GLA polypeptides are administered in combination with other pharmaceutical and/or dietary compositions.

EXPERIMENTAL

The following Examples, including experiments and results achieved, are provided for illustrative purposes only and are not to be construed as limiting the present invention.

In the experimental disclosure below, the following abbreviations apply: ppm (parts per million); M (molar); mM (millimolar), uM and µM (micromolar); nM (nanomolar); mol (moles); gm and g (gram); mg (milligrams); ug and µg (micrograms); L and l (liter); ml and mL (milliliter); cm (centimeters); mm (millimeters); um and µm (micrometers); sec. (seconds); min(s) (minute(s)); h(s) and hr(s) (hour(s)); U (units); MW (molecular weight); rpm (rotations per minute); ° C. (degrees Centigrade); CDS (coding sequence); DNA (deoxyribonucleic acid); RNA (ribonucleic acid); E. coli W3110 (commonly used laboratory E. coli strain, available from the Coli Genetic Stock Center [CGSC], New Haven, Conn.); HPLC (high pressure liquid chromatography); MWCO (molecular weight cut-off); SDS-PAGE (sodium dodecyl sulfate polyacrylamide gel electrophoresis); PBS (phosphate buffered saline); DPBS (Dulbecco's phosphate buffered saline); PES (polyethersulfone); CFSE (carboxyfluorescein succinimidyl ester); IPTG (isopropyl β-D-1-thiogalactopyranoside); PMBS (polymyxin B sulfate); NADPH (nicotinamide adenine dinucleotide phosphate); GlDH (glutamate dehydrogenase); FIOPC (fold improvements over positive control); PBMC (peripheral blood mononuclear cells); LB (Luria broth); MeOH (methanol); Athens Research (Athens Research Technology, Athens, Ga.); ProSpec (ProSpec Tany Technogene, East Brunswick, N.J.); Sigma-Aldrich (Sigma-Aldrich, St. Louis, Mo.); Ram Scientific (Ram Scientific, Inc., Yonkers, N.Y.); Pall Corp. (Pall, Corp., Pt. Washington, N.Y.); Millipore (Millipore, Corp., Billerica Mass.); Difco (Difco Laboratories, BD Diagnostic Systems, Detroit, Mich.); Molecular Devices (Molecular Devices, LLC, Sunnyvale, Calif.); Kuhner (Adolf Kuhner, AG, Basel, Switzerland); Axygen (Axygen, Inc., Union City, Calif.); Toronto Research Chemicals (Toronto Research Chemicals Inc., Toronto, Ontario, Canada); Cambridge Isotope Laboratories, (Cambridge Isotope Laboratories, Inc., Tewksbury, Mass.); Applied Biosystems (Applied Biosystems, part of Life Technologies, Corp., Grand Island, N.Y.), Agilent (Agilent Technologies, Inc., Santa Clara, Calif.); Thermo Scientific (part of ThermoFisher Scientific, Waltham, Mass.); Gibco (ThermoFisher Scientific); Pierce (Pierce Biotechnology (now part of Thermo Fisher Scientific), Rockford, Ill.); ThermoFisher Scientific (Thermo Fisher Scientific, Waltham, Mass.); Corning (Corning, Inc., Palo Alto, Calif.); XenoTech (Sekisui XenoTech, LLC, Kansas City, Kans.); Coriell Institute for Medical Research (Coriell Institute for Medical Research, Camden, N.J.); VWR (VWR International, Radnor, Pa.); Jackson (The Jackson Laboratory, Bar Harbor, Me.); Megazyme (Megazyme International, Wicklow, Ireland); Enzo (Enzo Life Sciences, Inc., Farmingdale, N.Y.); GE Healthcare (GE Healthcare Bio-Sciences, Piscataway, N.J.); LI-COR (LI-COR Biotechnology, Lincoln, Nebr.); Amicus (Amicus Therapeutics, Cranbury, N.J.); Phenomenex (Phenomenex, Inc., Torrance, Calif.); Optimal (Optimal Biotech Group, Belmont, Calif.); and Bio-Rad (Bio-Rad Laboratories, Hercules, Calif.).

The following polynucleotide and polypeptide sequences find use in the present invention. In some cases (as shown below), the polynucleotide sequence is followed by the encoded polypeptide.

Polynucleotide Sequence of Full Length Human GLA cDNA (SEQ ID NO. 1):

```
                                            (SEQ ID NO: 1)
ATGCAGCTGAGGAACCCAGAACTACATCTGGGCTGCGCGCTTGCGCTTCGC

TTCCTGGCCCTCGTTTCCTGGGACATCCCTGGGGCTAGAGCACTGGACAAT

GGATTGGCAAGGACGCCTACCATGGGCTGGCTGCACTGGGAGCGCTTCATG

TGCAACCTTGACTGCCAGGAAGAGCCAGATTCCTGCATCAGTGAGAAGCTC

TTCATGGAGATGGCAGAGCTCATGGTCTCAGAAGGCTGGAAGGATGCAGGT

TATGAGTACCTCTGCATTGATGACTGTTGGATGGCTCCCCAAAGAGATTCA

GAAGGCAGACTTCAGGCAGACCCTCAGCGCTTTCCTCATGGGATTCGCCAG

CTAGCTAATTATGTTCACAGCAAAGGACTGAAGCTAGGGATTTATGCAGAT

GTTGGAAATAAAACCTGCGCAGGCTTCCCTGGGAGTTTTGGATACTACGAC

ATTGATGCCCAGACCTTTGCTGACTGGGGAGTAGATCTGCTAAAATTTGAT

GGTTGTTACTGTGACAGTTTGGAAAATTTGGCAGATGGTTATAAGCACATG

TCCTTGGCCCTGAATAGGACTGGCAGAAGCATTGTGTACTCCTGTGAGTGG

CCTCTTTATATGTGGCCCTTTCAAAAGCCCAATTATACAGAAATCCGACAG
```

```
TACTGCAATCACTGGCGAAATTTTGCTGACATTGATGATTCCTGGAAAAGT

ATAAAGAGTATCTTGGACTGGACATCTTTTAACCAGGAGAGAATTGTTGAT

GTTGCTGGACCAGGGGGTTGGAATGACCCAGATATGTTAGTGATTGGCAAC

TTTGGCCTCAGCTGGAATCAGCAAGTAACTCAGATGGCCCTCTGGGCTATC

ATGGCTGCTCCTTTATTCATGTCTAATGACCTCCGACACATCAGCCCTCAA

GCCAAAGCTCTCCTTCAGGATAAGGACGTAATTGCCATCAATCAGGACCCC

TTGGGCAAGCAAGGGTACCAGCTTAGACAGGGAGACAACTTTGAAGTGTGG

GAACGACCTCTCTCAGGCTTAGCCTGGGCTGTAGCTATGATAAACCGGCAG

GAGATTGGTGGACCTCGCTCTTATACCATCGCAGTTGCTTCCCTGGGTAAA

GGAGTGGCCTGTAATCCTGCCTGCTTCATCACACAGCTCCTCCCTGTGAAA

AGGAAGCTAGGGTTCTATGAATGGACTTCAAGGTTAAGAAGTCACATAAAT

CCCACAGGCACTGTTTTGCTTCAGCTAGAAAATACAATGCAGATGTCATTA

AAAGACTTACTTTAG
```

Polypeptide Sequence of Full Length Human GLA:

(SEQ ID NO: 2)
```
MQLRNPELHLGCALALRFLALVSWDIPGARALDNGLARTPTMGWLHWERF

MCNLDCQEEPDSCISEKLFMEMAELMVSEGWKDAGYEYLCIDDCWMAPQR

DSEGRLQADPQRFPHGIRQLANYVHSKGLKLGIYADVGNKTCAGFPGSFG

YYDIDAQTFADWGVDLLKFDGCYCDSLENLADGYKHMSLALNRTGRSIVY

SCEWPLYMWPFQKPNYTEIRQYCNHWRNFADIDDSWKSIKSILDWTSFNQ

ERIVDVAGPGGWNDPDMLVIGNFGLSWNQQVTQMALWAIMAAPLFMSNDL

RHISPQAKALLQDKDVIAINQDPLGKQGYQLRQGDNFEVWERPLSGLAWA

VAMINRQEIGGPRSYTIAVASLGKGVACNPACFITQLLPVKRKLGFYEWT

SRLRSHINPTGTVLLQLENTMQMSLKDLL
```

Polynucleotide Sequence of Mature Yeast Codon-Optimized (yCDS) Human GLA:

(SEQ ID NO: 3)
```
TTGGATAACGGGTTAGCCCGTACACCTACTATGGGTTGGCTTCACTGGGAAAGATTCATG

TGTAACTTAGATTGCCAAGAAGAGCCTGACAGCTGTATCTCAGAGAAACTATTCATGGA

GATGGCTGAACTAATGGTAAGTGAAGGATGGAAGGATGCTGGTTATGAATACCTATGTA

TTGATGATTGCTGGATGGCTCCACAGCGTGATTCAGAAGGTAGGTTACAAGCTGACCCC

AGAGATTCCCACATGGCATACGTCAGCTTGCAAACTACGTACACAGCAAGGGTCTAAAG

TTAGGCATCTACGCTGATGTCGGAAACAAGACATGTGCTGGTTTCCCAGGTTCATTCGGT

TACTATGACATAGATGCGCAGACGTTTGCTGATTGGGGTGTTGATTTGTTGAAGTTTGAT

GGATGCTACTGCGATTCCCTGGAGAACCTAGCCGATGGGTACAAACACATGAGTTTGGCT

CTAAACAGGACTGGTAGGAGCATCGTCTATAGTTGTGAATGGCCCTTGTACATGTGGCCG

TTTCAGAAGCCAAACTACACTGAGATAAGACAATACTGTAACCATTGGCGTAACTTTGCT

GACATAGATGATTCATGGAAGTCAATCAAATCTATCTTGGATTGGACTTCTTTCAACCAG

GAAAGAATTGTTGATGTTGCAGGTCCAGGTGGATGGAATGACCCTGATATGCTTGTCATA

GGGAACTTTGGGCTATCATGGAATCAACAAGTTACACAAATGGCTTTGTGGGCGATCATG

GCCGCACCCCTATTCATGTCTAATGATCTACGTCACATATCACCCCAAGCAAAGGCTTTA

CTTCAAGATAAGGATGTCATAGCGATCAACCAAGATCCTCTTGGTAAACAAGGTTATCAA

TTGAGACAAGGTGACAACTTTGAAGTGTGGGAAAGACCATTGTCTGGACTTGCGTGGGC

TGTTGCTATGATCAACCGTCAAGAGATCGGAGGGCCAAGATCTTACACTATCGCGGTAGC

CTCTTTGGGTAAGGGTGTTGCGTGCAATCCTGCCTGCTTCATTACACAATTGCTTCCAGTT

AAGAGAAAGTTGGGTTTCTATGAGTGGACATCTAGGCTAAGAAGTCACATCAATCCTACT

GGTACGGTATTGTTGCAATTGGAGAACACAATGCAAATGTCTTTGAAAGATTTGTTA
```

Polynucleotide Sequence of Mature Human GLA (Native hCDS):

(SEQ ID NO: 4)
```
CTGGACAATGGATTGGCAAGGACGCCTACCATGGGCTGGCTGCACTGGGAGCGCTTCAT

GTGCAACCTTGACTGCCAGGAAGAGCCAGATTCCTGCATCAGTGAGAAGCTCTTCATGG
```

-continued

```
AGATGGCAGAGCTCATGGTCTCAGAAGGCTGGAAGGATGCAGGTTATGAGTACCTCTGC
ATTGATGACTGTTGGATGGCTCCCCAAAGAGATTCAGAAGGCAGACTTCAGGCAGACCC
TCAGCGCTTTCCTCATGGGATTCGCCAGCTAGCTAATTATGTTCACAGCAAAGGACTGAA
GCTAGGGATTTATGCAGATGTTGGAAATAAAACCTGCGCAGGCTTCCCTGGGAGTTTTGG
ATACTACGACATTGATGCCCAGACCTTTGCTGACTGGGGAGTAGATCTGCTAAAATTTGA
TGGTTGTTACTGTGACAGTTTGGAAAATTTGGCAGATGGTTATAAGCACATGTCCTTGGC
CCTGAATAGGACTGGCAGAAGCATTGTGTACTCCTGTGAGTGGCCTCTTTATATGTGGCC
CTTTCAAAAGCCCAATTATACAGAAATCCGACAGTACTGCAATCACTGGCGAAATTTTGC
TGACATTGATGATTCCTGGAAAAGTATAAAGAGTATCTTGGACTGGACATCTTTTAACCA
GGAGAGAATTGTTGATGTTGCTGGACCAGGGGGTTGGAATGACCCAGATATGTTAGTGA
TTGGCAACTTTGGCCTCAGCTGGAATCAGCAAGTAACTCAGATGCCCTCTGGGCTATCA
TGGCTGCTCCTTTATTCATGTCTAATGACCTCCGACACATCAGCCCTCAAGCCAAAGCTCT
CCTTCAGGATAAGGACGTAATTGCCATCAATCAGGACCCCTTGGGCAAGCAAGGGTACC
AGCTTAGACAGGGAGACAACTTTGAAGTGTGGGAACGACCTCTCTCAGGCTTAGCCTGG
GCTGTAGCTATGATAAACCGGCAGGAGATTGGTGGACCTCGCTCTTATACCATCGCAGTT
GCTTCCCTGGGTAAAGGAGTGGCCTGTAATCCTGCCTGCTTCATCACACAGCTCCTCCCT
GTGAAAAGGAAGCTAGGGTTCTATGAATGGACTTCAAGGTTAAGAAGTCACATAAATCC
CACAGGCACTGTTTTGCTTCAGCTAGAAAATACAATGCAGATGTCATTAAAAGACTTACT
T
```

Polypeptide Sequence of Mature Human GLA:

(SEQ ID NO: 5)
LDNGLARTPTMGWLHWERFMCNLDCQEEPDSCISEKLFMEMAELMVSEGW
KDAGYEYLCIDDCWMAPQRDSEGRLQADPQRFPHGIRQLANYVHSKGLKL
GIYADVGNKTCAGFPGSFGYYDIDAQTFADWGVDLLKFDGCYCDSLENLA
DGYKHMSLALNRTGRSIVYSCEWPLYMWPFQKPNYTEIRQYCNHWRNFAD
IDDSWKSIKSILDWTSFNQERIVDVAGPGGWNDPDMLVIGNFGLSWNQQV
TQMALWAIMAAPLFMSNDLRHISPQAKALLQDKDVIAINQDPLGKQGYQL
RQGDNFEVWERPLSGLAWAVAMINRQEIGGPRSYTIAVASLGKGVACNPA
CFITQLLPVKRKLGFYEWTSRLRSHINPTGTVLLQLENTMQMSLKDLL

Polynucleotide Sequence of pCK110900i E. coli Expression Vector:

(SEQ ID NO: 6)
```
TCGAGTTAATTAAGGCAGTGAGCGCAACGCAATTAATGTGAGTTAGCTCACTCATTAGGC
ACCCCAGGCTTTACACTTTATGCTTCCGGCTCGTATGTTGTGTGGAATTGTGAGCGGATA
ACAATTTCACACAGGAAACGGCTATGACCATGATTACGGATTCACTGGCCGTCGTTTTAC
AATCTAGAGGCCAGCCTGGCCATAAGGAGATATACATATGAGTATTCAACATTTCCGTGT
CGCCCTTATTCCCTTTTCTGCGGCATTTTGCCTTCCTGTTTTTGCTCACCCAGAAACGCTG
GTGAAAGTAAAAGATGCTGAAGATCAGTTGGGTGCACGAGTGGGTTACATCGAACTGGA
TCTCAACAGCGGTAAGATCCTTGAGAGTTTTCGCCCCGAAGAGCGTTTTCCAATGATGAG
CACTTTTAAAGTTCTGCTATGTGGCGCGGTATTATCCCGTGTTGACGCCGGGCAAGAGCA
ACTCGGTCGCCGCATACACTATTCTCAGAATGACTTGGTTGAGTACTCACCAGTCACAGA
AAAGCATCTTACGGATGGCATGACAGTAAGAGAATTATGCAGTGCTGCCATAACCATGA
GTGATAACACTGCGGCCAACTTACTTCTGACAACGATCGGAGGACCGAAGGAGCTAACC
GTTTTTTTGCACACCATGGGGGATCATGTAACTCGCCTTGATCGTTGGGAACCGGAGCTG
AATGAAGCCATACCAAACGACGAGCGTGACACCACGATGCCTACAGCAATGGCAACAAC
```

-continued

```
GTTGCGCAAACTATTAACTGGCGAACTACTTACTCTAGCTTCCCGGCAACAATTAATAGA

CTGGATGGAGGCGGATAAAGTTGCAGGACCACTTCTGCGCTCGGCCCTTCCGGCTGGCTG

GTTTATTGCTGATAAATCTGGAGCCGGTGAGCGTGGGTCTCGCGGTATCATTGCAGCACT

GGGGCCAGATGGTAAGCCCTCCCGTATCGTAGTTATCTACACGACGGGGAGTCAGGCAA

CTATGGATGAACGTAATAGACAGATCGCTGAGATAGGTGCCTCACTGATTAAGCATTGG

GGCCAAACTGGCCACCATCACCATCACCATTAGGGAAGAGCAGATGGGCAAGCTTGACC

TGTGAAGTGAAAAATGGCGCACATTGTGCGACATTTTTTTTGAATTCTACGTAAAAAGC

CGCCGATACATCGGCTGCTTTTTTTTTGATAGAGGTTCAAACTTGTGGTATAATGAAATA

AGATCACTCCGGGGCGTATTTTTTGAGTTATCGAGATTTTCAGGAGCTAAGGAAGCTAAA

ATGGAGAAAAAAATCACTGGATATACCACCGTTGATATATCCCAATGGCATCGTAAAGA

ACATTTTGAGGCATTTCAGTCAGTTGCTCAATGTACCTATAACCAGACCGTTCAGCTGGA

TATTACGGCCTTTTTAAAGACCGTAAAGAAAAATAAGCACAAGTTTTATCCGGCCTTTAT

TCACATTCTTGCCCGCCTGATGAATGCTCATCCGGAGTTCCGTATGGCAATGAAAGACGG

TGAGCTGGTGATATGGGATAGTGTTCACCCTTGTTACACCGTTTTCCATGAGCAAACTGA

AACGTTTTCATCGCTCTGGAGTGAATACCACGACGATTTCCGGCAGTTTCTACACATATA

TTCGCAAGATGTGGCGTGTTACGGTGAAAACCTGGCCTATTTCCCTAAAGGGTTTATTGA

GAATATGTTTTCGTCTCAGCCAATCCCTGGGTGAGTTTCACCAGTTTTGATTTAAACGTG

GCCAATATGGACAACTTCTTCGCCCCCGTTTTCACCATGGGCAAATATTATACGCAAGGC

GACAAGGTGCTGATGCCGCTGGCGATTCAGGTTCATCATGCCGTCTGTGATGGCTTCCAT

GTCGGCAGAATGCTTAATGAATTACAACAGTACTGCGATGAGTGGCAGGGCGGGGCGTA

ACTGCAGGAGCTCAAACAGCAGCCTGTATTCAGGCTGCTTTTTTCGTTTTGGTCTGCGCGT

AATCTCTTGCTCTGAAAACGAAAAAACCGCCTTGCAGGGCGGTTTTTCGAAGGTTCTCTG

AGCTACCAACTCTTTGAACCGAGGTAACTGGCTTGGAGGAGCGCAGTCACCAAAACTTG

TCCTTTCAGTTTAGCCTTAACCGGCGCATGACTTCAAGACTAACTCCTCTAAATCAATTAC

CAGTGGCTGCTGCCAGTGGTGCTTTTGCATGTCTTTCCGGGTTGGACTCAAGACGATAGT

TACCGGATAAGGCGCAGCGGTCGGACTGAACGGGGGGTTCGTGCATACAGTCCAGCTTG

GAGCGAACTGCCTACCCGGAACTGAGTGTCAGGCGTGGAATGAGACAAACGCGGCCATA

ACAGCGGAATGACACCGGTAAACCGAAAGGCAGGAACAGGAGAGCGCACGAGGGAGCC

GCCAGGGGAAACGCCTGGTATCTTTATAGTCCTGTCGGGTTTCGCCACCACTGATTTGA

GCGTCAGATTTCGTGATGCTTGTCAGGGGGCGGAGCCTATGGAAAAACGGCTTTGCCG

CGGCCCTCTCACTTCCCTGTTAAGTATCTTCCTGGCATCTTCCAGGAAATCTCCGCCCCGT

TCGTAAGCCATTTCCGCTCGCCGCAGTCGAACGACCGAGCGTAGCGAGTCAGTGAGCGA

GGAAGCGGAATATATCCTGTATCACATATTCTGCTGACGCACCGGTGCAGCCTTTTTCT

CCTGCCACATGAAGCACTTCACTGACACCCTCATCAGTGAACCACCGCTGGTAGCGGTGG

TTTTTTTAGGCCTATGGCCTTTTTTTTTGTGGGAAACCTTTCGCGGTATGGTATTAAAGC

GCCCGGAAGAGAGTCAATTCAGGGTGGTGAATGTGAAACCAGTAACGTTATACGATGTC

GCAGAGTATGCCGGTGTCTCTTATCAGACCGTTTCCCGCGTGGTGAACCAGGCCAGCCAC

GTTTCTGCGAAAACGCGGGAAAAAGTGGAAGCGGCGATGGCGGAGCTGAATTACATTCC

CAACCGCGTGGCACAACAACTGGCGGGCAAACAGTCGTTGCTGATTGGCGTTGCCACCT

CCAGTCTGGCCCTGCACGCGCCGTCGCAAATTGTCGCGGCGATTAAATCTCGCGCCGATC

AACTGGGTGCCAGCGTGGTGGTGTCGATGGTAGAACGAAGCGGCGTCGAAGCCTGTAAA
```

-continued

```
GCGGCGGTGCACAATCTTCTCGCGCAACGCGTCAGTGGGCTGATCATTAACTATCCGCTG

GATGACCAGGATGCCATTGCTGTGGAAGCTGCCTGCACTAATGTTCCGGCGTTATTTCTT

GATGTCTCTGACCAGACACCCATCAACAGTATTATTTTCTCCCATGAAGACGGTACGCGA

CTGGGCGTGGAGCATCTGGTCGCATTGGGTCACCAGCAAATCGCGCTGTTAGCGGGCCC

ATTAAGTTCTGTCTCGGCGCGTCTGCGTCTGGCTGGCTGGCATAAATATCTCACTCGCAA

TCAAATTCAGCCGATAGCGGAACGGGAAGGCGACTGGAGTGCCATGTCCGGTTTTCAAC

AAACCATGCAAATGCTGAATGAGGGCATCGTTTCCACTGCGATGCTGGTTGCCAACGATC

AGATGGCGCTGGGCGCAATGCGCGCCATTACCGAGTCCGGGCTGCGCGTTGGTGCGGAC

ATCTCGGTAGTGGGATACGACGATACCGAAGACAGCTCATGTTATATCCCGCCGTTAACC

ACCATCAAACAGGATTTTCGCCTGCTGGGGCAAACCAGCGTGGACCGCTTGCTGCAACTC

TCTCAGGGCCAGGCGGTTAAGGGCAATCAGCTGTTGCCCGTCTCACTGGTGAAAAGAAA

AACCACCCTGGCGCCCAATACGCAAACCGCCTCTCCCCGCGCGTTGGCCGATTCATTAAT

GCAGCTGGCACGACAGGTTTCCCGACTGGAAAGCGGGCAGTGAGCGGTACCCGATAAAA

GCGGCTTCCTGACAGGAGGCCGTTTTGTTTC
```

Polynucleotide Sequence of pYT-72Bgl Secreted Yeast Expression Vector:

```
                                                    (SEQ ID NO: 7)
TTTTTTTTTTTTTTTTTTTTTTTTTTTTTTTTTTTTTTTTTTTTTTGTACAAATATCATA

AAAAAAGAGAATCTTTTTAAGCAAGGATTTTCTTAACTTCTTCGGCGACAGCATCACCGA

CTTCGGTGGTACTGTTGGAACCACCTAAATCACCAGTTCTGATACCTGCATCCAAAACCT

TTTTAACTGCATCTTCAATGGCTTTACCTTCTTCAGGCAAGTTCAATGACAATTTCAACAT

CATTGCAGCAGACAAGATAGTGGCGATAGGGTTGACCTTATTCTTTGGCAAATCTGGAGC

GGAACCATGGCATGGTTCGTACAAACCAAATGCGGTGTTCTTGTCTGGCAAAGAGGCCA

AGGACGCAGATGGCAACAAACCCAAGGAGCCTGGGATAACGGAGGCTTCATCGGAGAT

GATATCACCAAACATGTTGCTGGTGATTATAATACCATTTAGGTGGGTTGGGTTCTTAAC

TAGGATCATGGCGGCAGAATCAATCAATTGATGTTGAACTTTCAATGTAGGGAATTCGTT

CTTGATGGTTTCCTCCACAGTTTTTCTCCATAATCTTGAAGAGGCCAAAACATTAGCTTTA

TCCAAGGACCAAATAGGCAATGGTGGCTCATGTTGTAGGGCCATGAAAGCGGCCATTCT

TGTGATTCTTTGCACTTCTGGAACGGTGTATTGTTCACTATCCCAAGCGACACCATCACCA

TCGTCTTCCTTTCTCTTACCAAAGTAAATACCTCCCACTAATTCTCTAACAACAACGAAGT

CAGTACCTTTAGCAAATTGTGGCTTGATTGGAGATAAGTCTAAAAGAGAGTCGGATGCA

AAGTTACATGGTCTTAAGTTGGCGTACAATTGAAGTTCTTTACGGATTTTTAGTAAACCTT

GTTCAGGTCTAACACTACCGGTACCCCATTTAGGACCACCCACAGCACCTAACAAAACG

GCATCAGCCTTTTTGGAGGCTTCCAGCGCCTCATTTGGAAGTGGAACACCTGTAGCATCG

ATAGCAGCCCCCCCAATTAAATGATTTTCGAAATCGAACTTGACATTGGAACGAACATCA

GAAATAGCTTTAAGAACCTTAATGGCTTCGGCTGTGATTTCTTGACCAACGTGGTCACCT

GGCAAAACGACGATTTTTTAGGGGCAGACATTACAATGGTATATCCTTGAAATATATAT

AAAAAAAAAAAAAAAAAAAAAAAAAAAAAATGCAGCTTCTCAATGATATTCGAATAC

GCTTTGAGGAGATACAGCCTAATATCCGACAAACTGTTTTACAGATTTACGATCGTACTT

GTTACCCATCATTGAATTTTGAACATCCGAACCTGGGAGTTTTCCCTGAAACAGATAGTA
```

```
TATTTGAACCTGTATAATAATATATAGTCTAGCGCTTTACGGAAGACAATGTATGTATTT
CGGTTCCTGGAGAAACTATTGCATCTATTGCATAGGTAATCTTGCACGTCGCATCCCCGG
TTCATTTTCTGCGTTTCCATCTTGCACTTCAATAGCATATCTTTGTTAACGAAGCATCTGT
GCTTCATTTTGTAGAACAAAAATGCAACGCGAGAGCGCTAATTTTTCAAACAAAGAATCT
GAGCTGCATTTTTACAGAACAGAAATGCAACGCGAAAGCGCTATTTTACCAACGAAGAA
TCTGTGCTTCATTTTTGTAAAACAAAAATGCAACGCGAGAGCGCTAATTTTTCAAACAAA
GAATCTGAGCTGCATTTTTACAGAACAGAAATGCAACGCGAGAGCGCTATTTTACCAAC
AAAGAATCTATACTTCTTTTTTGTTCTACAAAAATGCATCCCGAGAGCGCTATTTTTCTAA
CAAAGCATCTTAGATTACTTTTTTTCTCCTTTGTGCGCTCTATAATGCAGTCTCTTGATAA
CTTTTTGCACTGTAGGTCCGTTAAGGTTAGAAGAAGGCTACTTTGGTGTCTATTTTCTCTT
CCATAAAAAAAGCCTGACTCCACTTCCCGCGTTTACTGATTACTAGCGAAGCTGCGGGTG
CATTTTTTCAAGATAAAGGCATCCCCGATTATATTCTATACCGATGTGGATTGCGCATACT
TTGTGAACAGAAAGTGATAGCGTTGATGATTCTTCATTGGTCAGAAAATTATGAACGGTT
TCTTCTATTTTGTCTCTATATACTACGTATAGGAAATGTTTACATTTTCGTATTGTTTTCGA
TTCACTCTATGAATAGTTCTTACTACAATTTTTTTGTCTAAAGAGTAATACTAGAGATAAA
CATAAAAAATGTAGAGGTCGAGTTTAGATGCAAGTTCAAGGAGCGAAAGGTGGATGGGT
AGGTTATATAGGGATATAGCACAGAGATATATAGCAAAGAGATACTTTTGAGCAATGTT
TGTGGAAGCGGTATTCGCAATATTTTAGTAGCTCGTTACAGTCCGGTGCGTTTTTGGTTTT
TTGAAAGTGCGTCTTCAGAGCGCTTTTGGTTTTCAAAAGCGCTCTGAAGTTCCTATACTTT
CTAGAGAATAGGAACTTCGGAATAGGAACTTCAAAGCGTTTCCGAAAACGAGCGCTTCC
GAAAATGCAACGCGAGCTGCGCACATACAGCTCACTGTTCACGTCGCACCTATATCTGCG
TGTTGCCTGTATATATATATACATGAGAAGAACGGCATAGTGCGTGTTTATGCTTAAATG
CGTACTTATATGCGTCTATTTATGTAGGATGAAAGGTAGTCTAGTACCTCCTGTGATATTA
TCCCATTCCATGCGGGGTATCGTATGCTTCCTTCAGCACTACCCTTTAGCTGTTCTATATG
CTGCCACTCCTCAATTGGATTAGTCTCATCCTTCAATGCTATCATTTCCTTTGATATTGGA
TCATATGCATAGTACCGAGAAACTAGTGCGAAGTAGTGATCAGGTATTGCTGTTATCTGA
TGAGTATACGTTGTCCTGGCCACGGCAGAAGCACGCTTATCGCTCCAATTTCCCACAACA
TTAGTCAACTCCGTTAGGCCCTTCATTGAAAGAAATGAGGTCATCAAATGTCTTCCAATG
TGAGATTTTGGGCCATTTTTTATAGCAAAGATTGAATAAGGCGCATTTTTCTTCAAAGCTT
TATTGTACGATCTGACTAAGTTATCTTTTAATAATTGGTATTCCTGTTTATTGCTTGAAGA
ATTGCCGGTCCTATTTACTCGTTTTAGGACTGGTTCAGAATTCCTCAAAAATTCATCCAAA
TATACAAGTGGATCGATGATAAGCTGTCAAACATGAGAATTCTTGAAGACGAAAGGGCC
TCGTGATACGCCTATTTTTATAGGTTAATGTCATGATAATAATGGTTTCTTAGACGTCAGG
TGGCACTTTTCGGGGAAATGTGCGCGGAACCCCTATTTGTTTATTTTTCTAAATACATTCA
AATATGTATCCGCTCATGAGACAATAACCCTGATAAATGCTTCAATAATATTGAAAAAGG
AAGAGTATGAGTATTCAACATTTCCGTGTCGCCCTTATTCCCTTTTTTGCGGCATTTTGCC
TTCCTGTTTTTGCTCACCCAGAAACGCTGGTGAAAGTAAAAGATGCTGAAGATCAGTTGG
GTGCACGAGTGGGTTACATCGAACTGGATCTCAACAGCGGTAAGATCCTTGAGAGTTTTC
GCCCCGAAGAACGTTTTCCAATGATGAGCACTTTTAAAGTTCTGCTATGTGGCGCGGTAT
TATCCCGTGTTGACGCCGGGCAAGAGCAACTCGGTCGCCGCATACACTATTCTCAGAATG
```

-continued

```
ACTTGGTTGAGTACTCACCAGTCACAGAAAAGCATCTTACGGATGGCATGACAGTAAGA

GAATTATGCAGTGCTGCCATAACCATGAGTGATAACACTGCGGCCAACTTACTTCTGACA

ACGATCGGAGGACCGAAGGAGCTAACCGCTTTTTTGCACAACATGGGGGATCATGTAAC

TCGCCTTGATCGTTGGGAACCGGAGCTGAATGAAGCCATACCAAACGACGAGCGTGACA

CCACGATGCCTGCAGCAATGGCAACAACGTTGCGCAAACTATTAACTGGCGAACTACTT

ACTCTAGCTTCCCGGCAACAATTAATAGACTGGATGGAGGCGGATAAAGTTGCAGGACC

ACTTCTGCGCTCGGCCCTTCCGGCTGGCTGGTTTATTGCTGATAAATCTGGAGCCGGTGA

GCGTGGGTCTCGCGGTATCATTGCAGCACTGGGGCCAGATGGTAAGCCCTCCCGTATCGT

AGTTATCTACACGACGGGGAGTCAGGCAACTATGGATGAACGAAATAGACAGATCGCTG

AGATAGGTGCCTCACTGATTAAGCATTGGTAACTGTCAGACCAAGTTTACTCATATATAC

TTTAGATTGATTTAAAACTTCATTTTTAATTTAAAAGGATCTAGGTGAAGATCCTTTTTGA

TAATCTCATGACCAAAATCCCTTAACGTGAGTTTTCGTTCCACTGAGCGTCAGACCCCGT

AGAAAAGATCAAAGGATCTTCTTGAGATCCTTTTTTTCTGCGCGTAATCTGCTGCTTGCA

AACAAAAAAACCACCGCTACCAGCGGTGGTTTGTTTGCCGGATCAAGAGCTACCAACTC

TTTTTCCGAAGGTAACTGGCTTCAGCAGAGCGCAGATACCAAATACTGTCCTTCTAGTGT

AGCCGTAGTTAGGCCACCACTTCAAGAACTCTGTAGCACCGCCTACATACCTCGCTCTGC

TAATCCTGTTACCAGTGGCTGCTGCCAGTGGCGATAAGTCGTGTCTTACCGGGTTGGACT

CAAGACGATAGTTACCGGATAAGGCGCAGCGGTCGGGCTGAACGGGGGGTTCGTGCACA

CAGCCCAGCTTGGAGCGAACGACCTACACCGAACTGAGATACCTACAGCGTGAGCTATG

AGAAAGCGCCACGCTTCCCGAAGGGAGAAAGGCGGACAGGTATCCGGTAAGCGGCAGG

GTCGGAACAGGAGAGCGCACGAGGGAGCTTCCAGGGGGAAACGCCTGGTATCTTTATAG

TCCTGTCGGGTTTCGCCACCTCTGACTTGAGCGTCGATTTTTGTGATGCTCGTCAGGGGG

CGGAGCCTATGGAAAAACGCCAGCAACGCGGCCTTTTTACGGTTCCTGGCCTTTTGCTGG

CCTTTTGCTCACATGTTCTTTCCTGCGTTATCCCCTGATTCTGTGGATAACCGTATTACCG

CCTTTGAGTGAGCTGATACCGCTCGCCGCAGCCGAACGACCGAGCGCAGCGAGTCAGTG

AGCGAGGAAGCGGAAGAGCGCCTGATGCGGTATTTTCTCCTTACGCATCTGTGCGGTATT

TCACACCGCATATGGTGCACTCTCAGTACAATCTGCTCTGATGCCGCATAGTTAAGCCAG

TATACACTCCGCTATCGCTACGTGACTGGGTCATGGCTGCGCCCCGACACCCGCCAACAC

CCGCTGACGCGCCCTGACGGGCTTGTCTGCTCCCGGCATCCGCTTACAGACAAGCTGTGA

CCGTCTCCGGGAGCTGCATGTGTCAGAGGTTTTCACCGTCATCACCGAAACGCGCGAGGC

AGCTGCGGTAAAGCTCATCAGCGTGGTCGTGAAGCGATTCACAGATGTCTGCCTGTTCAT

CCGCGTCCAGCTCGTTGAGTTTCTCCAGAAGCGTTAATGTCTGGCTTCTGATAAAGCGGG

CCATGTTAAGGGCGGTTTTTTCCTGTTTGGTCACTGATGCCTCCGTGTAAGGGGATTTCT

GTTCATGGGGGTAATGATACCGATGAAACGAGAGAGGATGCTCACGATACGGGTTACTG

ATGATGAACATGCCCGGTTACTGGAACGTTGTGAGGGTAAACAACTGGCGGTATGGATG

CGGCGGGACCAGAGAAAAATCACTCAGGGTCAATGCCAGCGCTTCGTTAATACAGATGT

AGGTGTTCCACAGGGTAGCCAGCAGCATCCTGCGATGCAGATCCGGAACATAATGGTGC

AGGGCGCTGACTTCCGCGTTTCCAGACTTTACGAAACACGGAAACCGAAGACCATTCAT

GTTGTTGCTCAGGTCGCAGACGTTTTGCAGCAGCAGTCGCTTCACGTTCGCTCGCGTATC

GGTGATTCATTCTGCTAACCAGTAAGGCAACCCCGCCAGCCTAGCCGGGTCCTCAACGAC

AGGAGCACGATCATGCGCACCCGTGGCCAGGACCCAACGCTGCCCGAGATGCGCCGCGT
```

-continued

```
GCGGCTGCTGGAGATGGCGGACGCGATGGATATGTTCTGCCAAGGGTTGGTTTGCGCATT
CACAGTTCTCCGCAAGAATTGATTGGCTCCAATTCTTGGAGTGGTGAATCCGTTAGCGAG
GTGCCGCCGGCTTCCATTCAGGTCGAGGTGGCCCGGCTCCATGCACCGCGACGCAACGC
GGGGAGGCAGACAAGGTATAGGGCGGCGCCTACAATCCATGCCAACCCGTTCCATGTGC
TCGCCGAGGCGGCATAAATCGCCGTGACGATCAGCGGTCCAATGATCGAAGTTAGGCTG
GTAAGAGCCGCGAGCGATCCTTGAAGCTGTCCCTGATGGTCGTCATCTACCTGCCTGGAC
AGCATGGCCTGCAACGCGGGCATCCCGATGCCGCCGGAAGCGAGAAGAATCATAATGGG
GAAGGCCATCCAGCCTCGCGTCGCGAACGCCAGCAAGACGTAGCCCAGCGCGTCGGCCG
CCATGCCGGCGATAATGGCCTGCTTCTCGCCGAAACGTTTGGTGGCGGGACCAGTGACG
AAGGCTTGAGCGAGGGCGTGCAAGATTCCGAATACCGCAAGCGACAGGCCGATCATCGT
CGCGCTCCAGCGAAAGCGGTCCTCGCCGAAAATGACCCAGAGCGCTGCCGGCACCTGTC
CTACGAGTTGCATGATAAAGAAGACAGTCATAAGTGCGGCGACGATAGTCATGCCCCGC
GCCCACCGGAAGGAGCTGACTGGGTTGAAGGCTCTCAAGGGCATCGGTCGAGGATCTGG
GCAAAACGTAGGGGCAAACAAACGGAAAAATCGTTTCTCAAATTTTCTGATGCCAAGAA
CTCTAACCAGTCTTATCTAAAAATTGCCTTATGATCCGTCTCTCCGGTTACAGCCTGTGTA
ACTGATTAATCCTGCCTTTCTAATCACCATTCTAATGTTTTAATTAAGGGATTTTGTCTTC
ATTAACGGCTTTCGCTCATAAAAATGTTATGACGTTTTGCCCGCAGGCGGGAAACCATCC
ACTTCACGAGACTGATCTCCTCTGCCGGAACACCGGGCATCTCCAACTTATAAGTTGGAG
AAATAAGAGAATTTCAGATTGAGAGAATGAAAAAAAAAAAAAAAAAAAGGCAGAGGAG
AGCATAGAAATGGGGTTCACTTTTTGGTAAAGCTATAGCATGCCTATCACATATAAATAG
AGTGCCAGTAGCGACTTTTTTCACACTCGAAATACTCTTACTACTGCTCTCTTGTTGTTTT
TATCACTTCTTGTTTCTTCTTGGTAAATAGAATATCAAGCTACAAAAAGCATACAATCAA
CTATCAACTATTAACTATATCGTAATACACAGGATCCACCATGAAGGCTGCTGCGCTTTC
CTGCCTCTTCGGCAGTACCCTTGCCGTTGCAGGCGCCATTGAATCGAGAAAGGTTCACCA
GAAGCCCCTCGCGAGATCTGAACCTTTTTACCCGTCGCCATGGATGAATCCCAACGCCAT
CGGCTGGGCGGAGGCCTATGCCCAGGCCAAGTCCTTTGTCTCCCAAATGACTCTGCTAGA
GAAGGTCAACTTGACCACGGGAGTCGGCTGGGGGGAGGAGCAGTGCGTCGGCAACGTG
GGCGCGATCCCTCGCCTTGGACTTCGCAGTCTGTGCATGCATGACTCCCCTCTCGGCGTG
CGAGGAACCGACTACAACTCAGCGTTCCCCTCTGGCCAGACCGTTGCTGCTACCTGGGAT
CGCGGTCTGATGTACCGTCGCGGCTACGCAATGGGCCAGGAGGCCAAAGGCAAGGGCAT
CAATGTCCTTCTCGGACCAGTCGCCGGCCCCCTTGGCCGCATGCCCGAGGGCGGTCGTAA
CTGGGAAGGCTTCGCTCCGGATCCCGTCCTTACCGGCATCGGCATGTCCGAGACGATCAA
GGGCATTCAGGATGCTGGCGTCATCGCTTGTGCGAAGCACTTTATTGGAAACGAGCAGG
AGCACTTCAGACAGGTGCCAGAAGCCCAGGGATACGGTTACAACATCAGCGAAACCCTC
TCCTCCAACATTGACGACAAGACCATGCACGAGCTCTACCTTTGGCCGTTTGCCGATGCC
GTCCGGGCCGGCGTCGGCTCTGTCATGTGCTCGTACAACCAGGGCAACAACTCGTACGCC
TGCCAGAACTCGAAGCTGCTGAACGACCTCCTCAAGAACGAGCTTGGGTTTCAGGGCTTC
GTCATGAGCGACTGGTGGGCACAGCACACTGGCGCAGCAAGCGCCGTGGCTGGTCTCGA
TATGTCCATGCCGGGCGACACCATGGTCAACACTGGCGTCAGTTTCTGGGGCGCCAATCT
CACCCTCGCCGTCCTCAACGGCACAGTCCCTGCCTACCGTCTCGACGACATGTGCATGCG
```

-continued

```
CATCATGGCCGCCCTCTTCAAGGTCACCAAGACCACCGACCTGGAACCGATCAACTTCTC

CTTCTGGACCCGCGACACTTATGGCCCGATCCACTGGGCCGCCAAGCAGGGCTACCAGG

AGATTAATTCCCACGTTGACGTCCGCGCCGACCACGGCAACCTCATCCGGAACATTGCCG

CCAAGGGTACGGTGCTGCTGAAGAATACCGGCTCTCTACCCCTGAACAAGCCAAAGTTC

GTGGCCGTCATCGGCGAGGATGCTGGGCCGAGCCCCAACGGGCCCAACGGCTGCAGCGA

CCGCGGCTGTAACGAAGGCACGCTCGCCATGGGCTGGGGATCCGGCACAGCCAACTATC

CGTACCTCGTTTCCCCCGACGCCGCGCTCCAGGCGCGGGCCATCCAGGACGGCACGAGG

TACGAGAGCGTCCTGTCCAACTACGCCGAGGAAAATACAAAGGCTCTGGTCTCGCAGGC

CAATGCAACCGCCATCGTCTTCGTCAATGCCGACTCAGGCGAGGGCTACATCAACGTGG

ACGGTAACGAGGGCGACCGTAAGAACCTGACTCTCTGGAACAACGGTGATACTCTGGTC

AAGAACGTCTCGAGCTGGTGCAGCAACACCATCGTCGTCATCCACTCGGTCGGCCCGGTC

CTCCTGACCGATTGGTACGACAACCCCAACATCACGGCCATTCTCTGGGCTGGTCTTCCG

GGCCAGGAGTCGGGCAACTCCATCACCGACGTGCTTTACGGCAAGGTCAACCCCGCCGC

CCGCTCGCCCTTCACTTGGGGCAAGACCCGCGAAAGCTATGGCGCGGACGTCCTGTACA

AGCCGAATAATGGCAATTGGGCGCCCCAACAGGACTTCACCGAGGGCGTCTTCATCGAC

TACCGCTACTTCGACAAGGTTGACGATGACTCGGTCATCTACGAGTTCGGCCACGGCCTG

AGCTACACCACCTTCGAGTACAGCAACATCCGCGTCGTCAAGTCCAACGTCAGCGAGTA

CCGGCCCACGACGGGCACCACGATTCAGGCCCCGACGTTTGGCAACTTCTCCACCGACCT

CGAGGACTATCTCTTCCCCAAGGACGAGTTCCCCTACATCCCGCAGTACATCTACCCGTA

CCTCAACACGACCGACCCCCGGAGGGCCTCGGGCGATCCCCACTACGGCCAGACCGCCG

AGGAGTTCCTCCCGCCCCACGCCACCGATGACGACCCCCAGCCGCTCCTCCGGTCCTCGG

GCGGAAACTCCCCCGGCGGCAACCGCCAGCTGTACGACATTGTCTACACAATCACGGCC

GACATCACGAATACGGGCTCCGTTGTAGGCGAGGAGGTACCGCAGCTCTACGTCTCGCT

GGGCGGTCCCGAGGATCCCAAGGTGCAGCTGCGCGACTTTGACAGGATGCGGATCGAAC

CCGGCGAGACGAGGCAGTTCACCGGCCGCCTGACGCGCAGAGATCTGAGCAACTGGGAC

GTCACGGTGCAGGACTGGGTCATCAGCAGGTATCCCAAGACGGCATATGTTGGGAGGAG

CAGCCGGAAGTTGGATCTCAAGATTGAGCTTCCTTGATAAGTCGACCTCGACTTTGTTCC

CACTGTACTTTTAGCTCGTACAAAATACAATATACTTTTCATTTCTCCGTAAACAACATGT

TTTCCCATGTAATATCCTTTTCTATTTTTCGTTCCGTTACCAACTTTACACATACTTTATAT

AGCTATTCACTTCTATACACTAAAAAACTAAGACAATTTTAATTTTGCTGCCTGCCATATT

TCAATTTGTTATAAATTCCTATAATTTATCCTATTAGTAGCTAAAAAAAGATGAATGTGA

ATCGAATCCTAAGAGAATTGGATCTGATCCACAGGACGGGTGTGGTCGCCATGATCGCG

TAGTCGATAGTGGCTCCAAGTAGCGAAGCGAGCAGGACTGGGCGGCGGCCAAAGCGGTC

GGACAGTGCTCCGAGAACGGGTGCGCATAGAAATTGCATCAACGCATATAGCGCTAGCA

GCACGCCATAGTGACTGGCGATGCTGTCGGAATGGACGATATCCCGCAAGAGGCCCGGC

AGTACCGGCATAACCAAGCCTATGCCTACAGCATCCAGGGTGACGGTGCCGAGGATGAC

GATGAGCGCATTGTTAGATTTCATACACGGTGCCTGACTGCGTTAGCAATTTAACTGTGA

TAAACTACCGCATTAAAGCTTTTTCTTTCCAATTTTTTTTTTTCGTCATTATAAAAATCAT

TACGACCGAGATTCCCGGGTAATAACTGATATAATTAAATTGAAGCTCTAATTTGTGAGT

TTAGTATACATGCATTTACTTATAATACAGTTTTTTAGTTTTGCTGGCCGCATCTTCTCAA

ATATGCTTCCCAGCCTGCTTTTCTGTAACGTTCACCCTCTACCTTAGCATCCCTTCCCTTTG
```

-continued

```
CAAATAGTCCTCTTCCAACAATAATAATGTCAGATCCTGTAGAGACCACATCATCCACGG

TTCTATACTGTTGACCCAATGCGTCTCCCTTGTCATCTAAACCCACACCGGGTGTCATAAT

CAACCAATCGTAACCTTCATCTCTTCCACCCATGTCTCTTTGAGCAATAAAGCCGATAAC

AAAATCTTTGTCGCTCTTCGCAATGTCAACAGTACCCTTAGTATATTCTCCAGTAGATAG

GGAGCCCTTGCATGACAATTCTGCTAACATCAAAAGGCCTCTAGGTTCCTTTGTTACTTCT

TCTGCCGCCTGCTTCAAACCGCTAACAATACCTGGGCCCACCACACCGTGTGCATTCGTA

ATGTCTGCCCATTCTGCTATTCTGTATACACCCGCAGAGTACTGCAATTTGACTGTATTAC

CAATGTCAGCAAATTTTCTGTCTTCGAAGAGTAAAAAATTGTACTTGGCGGATAATGCCT

TTAGCGGCTTAACTGTGCCCTCCATGGAAAAATCAGTCAAGATATCCACATGTGTTTTTA

GTAAACAAATTTTGGGACCTAATGCTTCAACTAACTCCAGTAATTCCTTGGTGGTACGAA

CATCCAATGAAGCACACAAGTTTGTTTGCTTTTCGTGCATGATATTAAATAGCTTGGCAG

CAACAGGACTAGGATGAGTAGCAGCACGTTCCTTATATGTAGCTTTCGACATGATTTATC

TTCGTTTCCTGCAGGTTTTTGTTCTGTGCAGTTGGGTTAAGAATACTGGGCAATTTCATGT

TTCTTCAACACTACATATGCGTATATATACCAATCTAAGTCTGTGCTCCTTCCTTCGTTCT

TCCTTCTGTTCGGAGATTACCGAATCAAAAAATTTCAAGGAAACCGAAATCAAAAAAA

AGAATAAAAAAAAAATGATGAATTGAAAAGCTTATCGATCCTACCCCTTGCGCTAAAGA

AGTATATGTGCCTACTAACGCTTGTCTTTGTCTCTGTCACTAAACACTGGATTATTACTCC

CAGATACTTATTTTGGACTAATTTAAATGATTTCGGATCAACGTTCTTAATATCGCTGAAT

CTTCCACAATTGATGAAAGTAGCTAGGAAGAGGAATTGGTATAAAGTTTTTGTTTTTGTA

AATCTCGAAGTATACTCAAACGAATTTAGTATTTTCTCAGTGATCTCCCAGATGCTTTCAC

CCTCACTTAGAAGTGCTTTAAGCATTTTTTTACTGTGGCTATTTCCCTTATCTGCTTCTTCC

GATGATTCGAACTGTAATTGCAAACTACTTACAATATCAGTGATATCAGATTGATGTTTT

TGTCCATAGTAAGGAATAATTGTAAATTCCCAAGCAGGAATCAATTTCTTTAATGAGGCT

TCCAGAATTGTTGCTTTTTGCGTCTTGTATTTAAACTGGAGTGATTTATTGACAATATCGA

AACTCAGCGAATTGCTTATGATAGTATTATAGCTCATGAATGTGGCTCTCTTGATTGCTGT

TCCGTTATGTGTAATCATCCAACATAAATAGGTTAGTTCAGCAGCACATAATGCTATTTT

CTCACCTGAAGGTCTTTCAAACCTTTCCACAAACTGACGAACAAGCACCTTAGGTGGTGT

TTTACATAATATATCAAATTGTGGCATGCTTAGCGCCGATCTTGTGTGCAATTGATATCTA

GTTTCAACTACTCTATTTATCTTGTATCTTGCAGTATTCAAACACGCTAACTCGAAAAACT

AACTTTAATTGTCCTGTTTGTCTCGCGTTCTTTCGAAAAATGCACCGGCCGCGCATTATTT

GTACTGCGAAATAATTGGTACTGCGGTATCTTCATTTCATATTTTAAAAATGCACCTTTG

CTGCTTTTCCTTAATTTTTAGACGGCCCGCAGGTTCGTTTTGCGGTACTATCTTGTGATAA

AAAGTTGTTTTGACATGTGATCTGCACAGATTTTATAATGTAATAAGCAAGAATACATTA

TCAAACGAACAATACTGGTAAAAGAAAACCAAATGGACGACATTGAAACAGCCAAGA

ATCTGACGGTAAAAGCACGTACAGCTTATAGCGTCTGGGATGTATGTCGGCTGTTTATTG

AAATGATTGCTCCTGATGTAGATATTGATATAGAGAGTAAACGTAAGTCTGATGAGCTAC

TCTTTCCAGGATATGTCATAAGGCCCATGGAATCTCTCACAACCGGTAGGCCGTATGGTC

TTGATTCTAGCGCAGAAGATTCCAGCGTATCTTCTGACTCCAGTGCTGAGGTAATTTTGC

CTGCTGCGAAGATGGTTAAGGAAAGGTTTGATTCGATTGGAAATGGTATGCTCTCTTCAC

AAGAAGCAAGTCAGGCTGCCATAGATTTGATGCTACAGAATAACAAGCTGTTAGACAAT
```

-continued

```
AGAAAGCAACTATACAAATCTATTGCTATAATAATAGGAAGATTGCCCGAGAAAGACAA

GAAGAGAGCTACCGAAATGCTCATGAGAAAAATGGATTGTACACAGTTATTAGTCCCAC

CAGCTCCAACGGAAGAAGATGTTATGAAGCTCGTAAGCGTCGTTACCCAATTGCTTACTT

TAGTTCCACCAGATCGTCAAGCTGCTTTAATAGGTGATTTATTCATCCCGGAATCTCTAA

AGGATATATTCAATAGTTTCAATGAACTGGCGGCAGAGAATCGTTTACAGCAAAAAAAG

AGTGAGTTGGAAGGAAGGACTGAAGTGAACCATGCTAATACAAATGAAGAAGTTCCCTC

CAGGCGAACAAGAAGTAGAGACACAAATGCAAGAGGAGCATATAAATTACAAAACACC

ATCACTGAGGGCCCTAAAGCGGTTCCCACGAAAAAAAGGAGAGTAGCAACGAGGGTAA

GGGGCAGAAAATCACGTAATACTTCTAGGGTATGATCCAATATCAAAGGAAATGATAGC

ATTGAAGGATGAGACTAATCCAATTGAGGAGTGGCAGCATATAGAACAGCTAAAGGGTA

GTGCTGAAGGAAGCATACGATACCCCGCATGGAATGGGATAATATCACAGGAGGTACTA

GACTACCTTTCATCCTACATAAATAGACGCATATAAGTACGCATTTAAGCATAAACACGC

ACTATGCCGTTCTTCTCATGTATATATATATACAGGCAACACGCAGATATAGGTGCGACG

TGAACAGTGAGCTGTATGTGCGCAGCTCGCGTTGCATTTTCGGAAGCGCTCGTTTTCGGA

AACGCTTTGAAGTTCCTATTCCGAAGTTCCTATTCTCTAGAAAGTATAGGAACTTCAGAG

CGCTTTTGAAAACCAAAAGCGCTCTGAAGACGCACTTTCAAAAAACCAAAAACGCACCG

GACTGTAACGAGCTACTAAAATATTGCGAATACCGCTTCCACAAACATTGCTCAAAGTA

TCTCTTTGCTATATATCTCTGTGCTATATCCCTATATAACCTACCCATCCACCTTTCGCTCC

TTGAACTTGCATCTAAACTCGACCTCTACATCAACAGGCTTCCAATGCTCTTCAAATTTTA

CTGTCAAGTAGACCCATACGGCTGTAATATGCTGCTCTTCATAATGTAAGCTTATCTTTAT

CGAATCGTGTGAAAAACTACTACCGCGATAAACCTTTACGGTTCCCTGAGATTGAATTAG

TTCCTTTAGTATATGATACAAGACACTTTTGAACTTTGTACGACGAATTTTGAGGTTCGCC

ATCCTCTGGCTATTTCCAATTATCCTGTCGGCTATTATCTCCGCCTCAGTTTGATCTTCCGC

TTCAGACTGCCATTTTTCACATAATGAATCTATTTCACCCCACAATCCTTCATCCGCCTCC

GCATCTTGTTCCGTTAAACTATTGACTTCATGTTGTACATTGTTTAGTTCACGAGAAGGGT

CCTCTTCAGGCGGTAGCTCCTGATCTCCTATATGACCTTTATCCTGTTCTCTTTCCACAAA

CTTAGAAATGTATTCATGAATTATGGAGCACCTAATAACATTCTTCAAGGCGGAGAAGTT

TGGGCCAGATGCCCAATATGCTTGACATGAAAACGTGAGAATGAATTTAGTATTATTGTG

ATATTCTGAGGCAATTTTATTATAATCTCGAAGATAAGAGAAGAATGCAGTGACCTTTGT

ATTGACAAATGGAGATTCCATGTATCTAAAAAATACGCCTTTAGGCCTTCTGATACCCTT

TCCCCTGCGGTTTAGCGTGCCTTTTACATTAATATCTAAACCCTCTCCGATGGTGGCCTTT

AACTGACTAATAAATGCAACCGATATAAACTGTGATAATTCTGGGTGATTTATGATTCGA

TCGACAATTGTATTGTACACTAGTGCAGGATCAGGCCAATCCAGTTCTTTTTCAATTACC

GGTGTGTCGTCTGTATTCAGTACATGTCCAACAAATGCAAATGCTAACGTTTTGTATTTCT

TATAATTGTCAGGAACTGGAAAAGTCCCCCTTGTCGTCTCGATTACACACCTACTTTCATC

GTACACCATAGGTTGGAAGTGCTGCATAATACATTGCTTAATACAAGCAAGCAGTCTCTC

GCCATTCATATTTCAGTTATTTTCCATTACAGCTGATGTCATTGTATATCAGCGCTGTAAA

AATCTATCTGTTACAGAAGGTTTTCGCGGTTTTTATAAACAAAACTTTCGTTACGAAATC

GAGCAATCACCCCAGCTGCGTATTTGGAAATTCGGGAAAAAGTAGAGCAACGCGAGTTG

CATTTTTTACACCATAATGCATGATTAACTTCGAGAAGGGATTAAGGCTAATTTCACTAG

TATGTTTCAAAAACCTCAATCTGTCCATTGAATGCCTTATAAAACAGCTATAGATTGCAT
```

-continued

AGAAGAGTTAGCTACTCAATGCTTTTTGTCAAAGCTTACTGATGATGATGTGTCTACTTTC

AGGCGGGTCTGTAGTAAGGAGAATGACATTATAAAGCTGGCACTTAGAATTCCACGGAC

TATAGACTATACTAGTATACTCCGTCTACTGTACGATACACTTCCGCTCAGGTCCTTGTCC

TTTAACGAGGCCTTACCACTCTTTTGTTACTCTATTGATCCAGCTCAGCAAAGGCAGTGTG

ATCTAAGATTCTATCTTCGCGATGTAGTAAAACTAGCTAGACCGAGAAAGAGACTAGAA

ATGCAAAAGGCACTTCTACAATGGCTGCCATCATTATTATCCGATGTGACGCTGCA

Polynucleotide Sequence of Variant No. 73 yCDS:

(SEQ ID NO: 8)
TTGGATAACGGGTTAGCCCGTACACCTACTATGGGTTGGCTTCACTGGGAAAGATTCATG

TGTAACTTAGATTGCCAAGAAGAGCCTGACAGCTGTATCTCAGAGAAACTATTCATGGA

GATGGCTGAACTAATGGTAAGTGAAGGATGGAAGGATGCTGGTTATGAATACCTATGTA

TTGATGATTGCTGGATGGCTCCACAGCGTGATTCAGAAGGTAGGTTACAAGCTGACCCCC

AGAGATTCCCACATGGCATACGTCAGCTTGCAAACTACGTACACAGCAAGGGTCTAAAG

TTAGGCATCTACGCTGATGTCGGAAACAAGACATGTGCTGGTTTCCCAGGTTCATTCGGT

TACTATGACATAGATGCGCAGACGTTTGCTGATTGGGGTGTTGATTTGTTGAAGTTTGAT

GGATGCTACTGCGATTCCCTGGAGAACCTAGCCGATGGGTACAAACACATGAGTTTGGCT

CTAAACAGGACTGGTAGGAGCATCGTCTATAGTTGTGAATGGCCCTTGTACATGTGGCCG

TTTCAGAAGCCAAACTACACTGAGATAAGACAATACTGTAACCATTGGCGTAACTTTGCT

GACATAGATGATTCATGGGCTTCAATCAAATCTATCTTGGATTGGACTTCTTTCAACCAG

GAAAGAATTGTTGATGTTGCAGGTCCAGGTGGATGGAATGACCCTGATATGCTTGTCATA

GGGAACTTTGGGCTATCATGGAATCAACAAGTTACACAAATGGCTTTGTGGGCGATCATG

GCCGCACCCCTATTCATGTCTAATGATCTACGTCACATATCACCCCAAGCAAAGGCTTTA

CTTCAAGATAAGGATGTCATAGCGATCAACCAAGATCCTCTTGGTAAACAAGGTTATCAA

TTGAGACAAGGTGACAACTTTGAAGTGTGGGAAAGACCATTGTCTGGACTTGCGTGGGC

TGTTGCTATGATCAACCGTCAAGAGATCGGAGGGCCAAGATCTTACACTATCGCGGTAGC

CTCTTTGGGTAAGGGTGTTGCGTGCAATCCTGCCTGCTTCATTACACAATTGCTTCCAGTT

AAGAGAAAGTTGGGTTTCTATGAGTGGACATCTAGGCTAAGAAGTCACATCAATCCTACT

GGTACGGTATTGTTGCAATTGGAGAACACAATGCAAATGTCTTTGAAAGATTTGTTA

Polynucleotide Sequence of Variant No. 73:

(SEQ ID NO: 9)
CTGGACAATGGATTGGCAAGGACGCCTACCATGGGCTGGCTGCACTGGGAGCGCTTCAT

GTGCAACCTTGACTGCCAGGAAGAGCCAGATTCCTGCATCAGTGAGAAGCTCTTCATGG

AGATGGCAGAGCTCATGGTCTCAGAAGGCTGGAAGGATGCAGGTTATGAGTACCTCTGC

ATTGATGACTGTTGGATGGCTCCCCAAAGAGATTCAGAAGGCAGACTTCAGGCAGACCC

TCAGCGCTTTCCTCATGGGATTCGCCAGCTAGCTAATTATGTTCACAGCAAAGGACTGAA

GCTAGGGATTTATGCAGATGTTGGAAATAAAACCTGCGCAGGCTTCCCTGGGAGTTTTGG

ATACTACGACATTGATGCCCAGACCTTTGCTGACTGGGGAGTAGATCTGCTAAAATTTGA

TGGTTGTTACTGTGACAGTTTGGAAAATTTGGCAGATGGTTATAAGCACATGTCCTTGGC

CCTGAATAGGACTGGCAGAAGCATTGTGTACTCCTGTGAGTGGCCTCTTTATATGTGGCC

```
CTTTCAAAAGCCCAATTATACAGAAATCCGACAGTACTGCAATCACTGGCGAAATTTTGC

TGACATTGATGATTCCTGGGCGAGTATAAAGAGTATCTTGGACTGGACATCTTTTAACCA

GGAGAGAATTGTTGATGTTGCTGGACCAGGGGGTTGGAATGACCCAGATATGTTAGTGA

TTGGCAACTTTGGCCTCAGCTGGAATCAGCAAGTAACTCAGATGGCCCTCTGGGCTATCA

TGGCTGCTCCTTTATTCATGTCTAATGACCTCCGACACATCAGCCCTCAAGCCAAAGCTCT

CCTTCAGGATAAGGACGTAATTGCCATCAATCAGGACCCCTTGGGCAAGCAAGGGTACC

AGCTTAGACAGGGAGACAACTTTGAAGTGTGGGAACGACCTCTCTCAGGCTTAGCCTGG

GCTGTAGCTATGATAAACCGGCAGGAGATTGGTGGACCTCGCTCTTATACCATCGCAGTT

GCTTCCCTGGGTAAAGGAGTGGCCTGTAATCCTGCCTGCTTCATCACACAGCTCCTCCCT

GTGAAAAGGAAGCTAGGGTTCTATGAATGGACTTCAAGGTTAAGAAGTCACATAAATCC

CACAGGCACTGTTTTGCTTCAGCTAGAAAATACAATGCAGATGTCATTAAAAGACTTACT

T
```

Polypeptide Sequence of Variant No. 73:

(SEQ ID NO: 10)
```
LDNGLARTPTMGWLHWERFMCNLDCQEEPDSCISEKLFMEMAELMVSEGW

KDAGYEYLCIDDCWMAPQRDSEGRLQADPQRFPHGIRQLANYVHSKGLKL

GIYADVGNKTCAGFPGSFGYYDIDAQTFADWGVDLLKFDGCYCDSLENLA

DGYKHMSLALNRTGRSIVYSCEWPLYMWPFQKPNYTEIRQYCNHWRNFAD

IDDSWASIKSILDWTSFNQERIVDVAGPGGWNDPDMLVIGNFGLSWNQQV

TQMALWAIMAAPLFMSNDLRHISPQAKALLQDKDVIAINQDPLGKQGYQL

RQGDNFEVWERPLSGLAWAVAMINRQEIGGPRSYTIAVASLGKGVACNPA

CFITQLLPVKRKLGFYEWTSRLRSHINPTGTVLLQLENTMQMSLKDLL
```

Polynucleotide Sequence of Variant No. 218 yCDS:

(SEQ ID NO: 11)
```
TTGGATAACGGGTTAGCCCGTACACCTACTATGGGTTGGCTTCACTGGGAAAGATTCATG

TGTAACTTAGATTGCCAAGAAGAGCCTGACAGCTGTATCTCAGAGAAACTATTCATGGA

GATGGCTGAACTAATGGTAAGTGAAGGATGGAAGGATGCTGGTTATGAATACCTATGTA

TTGATGATTGCTGGATGGCTCCACAGCGTGATTCAGAAGGTAGGTTACAAGCTGACCCCC

AGAGATTCCCACATGGCATACGTCAGCTTGCAAACTACGTACACAGCAAGGGTCTAAAG

TTAGGCATCTACGCTGATGTCGGAAACAAGACATGTGCTGGTTTCCCAGGTTCATTCGGT

TACTATGACATAGATGCGCAGACGTTTGCTGATTGGGGTGTTGATTTGTTGAAGTTTGAT

GGATGCTACTGCGATTCCCTGGAGAACCTAGCCGATGGGTACAAACACATGAGTTTGGCT

CTAAACAGGACTGGTAGGAGCATCGTCTATAGTTGTGAATGGCCCTTGTACATGTGGCCG

TTTCAGAAGCCAAACTACACTGAGATAAGACAATACTGTAACCATTGGCGTAACTTTGCT

GACATAGATGATTCATGGGCTTCAATCAAATCTATCTTGGATTGGACTTCTTTCAACCAG

GAAAGAATTGTTGATGTTGCAGGTCCAGGTGGATGGAATGACCCTGATATGCTTGTCATA

GGGAACTTTGGGCTATCATGGAATCAACAAGTTACACAAATGGCTTTGTGGGCGATCATG

GCCGCACCCCTATTCATGTCTAATGATCTACGTCACATATCACCCCAAGCAAAGGCTTTA

CTTCAAGATAAGGATGTCATAGCGATCAACCAAGATCCTCTTGGTAAACAAGGTTATCAA

TTGAGACAAGGTGACAACTTTGAAGTGTGGGAAAGACCATTGTCTGGACTTGCGTGGGC

TGTTGCTATTATCAACCGTCAAGAGATCGGAGGGCCAAGATCTTACACTATCGCGGTAGC

CTCTTTGGGTAAGGGTGTTGCGTGCAATCCTGCCTGCTTCATTACACAATTGCTTCCAGTT

AAGAGAAAGTTGGGTTTCTATAACTGGACATCTAGGCTAAAAAGTCACATTAATCCTACT

GGTACGGTATTGTTGCAATTGGAGAACACAATGCAAATGTCTTTGAAAGATTTGTTA
```

Polynucleotide Sequence of Variant No. 218 hCDS:

(SEQ ID NO: 12)
CTGGACAATGGATTGGCAAGGACGCCTACCATGGGCTGGCTGCACTGGGAGCGCTTCAT

GTGCAACCTTGACTGCCAGGAAGAGCCAGATTCCTGCATCAGTGAGAAGCTCTTCATGG

AGATGGCAGAGCTCATGGTCTCAGAAGGCTGGAAGGATGCAGGTTATGAGTACCTCTGC

ATTGATGACTGTTGGATGGCTCCCCAAAGAGATTCAGAAGGCAGACTTCAGGCAGACCC

TCAGCGCTTTCCTCATGGGATTCGCCAGCTAGCTAATTATGTTCACAGCAAAGGACTGAA

GCTAGGGATTTATGCAGATGTTGGAAATAAAACCTGCGCAGGCTTCCCTGGGAGTTTTGG

ATACTACGACATTGATGCCCAGACCTTTGCTGACTGGGGAGTAGATCTGCTAAAATTTGA

TGGTTGTTACTGTGACAGTTTGGAAAATTTGGCAGATGGTTATAAGCACATGTCCTTGGC

CCTGAATAGGACTGGCAGAAGCATTGTGTACTCCTGTGAGTGGCCTCTTTATATGTGGCC

CTTTCAAAAGCCCAATTATACAGAAATCCGACAGTACTGCAATCACTGGCGAAATTTTGC

TGACATTGATGATTCCTGGGCGAGTATAAAGAGTATCTTGGACTGGACATCTTTTAACCA

GGAGAGAATTGTTGATGTTGCTGGACCAGGGGGTTGGAATGACCCAGATATGTTAGTGA

TTGGCAACTTTGGCCTCAGCTGGAATCAGCAAGTAACTCAGATGGCCCTCTGGGCTATCA

TGGCTGCTCCTTTATTCATGTCTAATGACCTCCGACACATCAGCCCTCAAGCCAAAGCTCT

CCTTCAGGATAAGGACGTAATTGCCATCAATCAGGACCCCTTGGGCAAGCAAGGGTACC

AGCTTAGACAGGGAGACAACTTTGAAGTGTGGGAACGACCTCTCTCAGGCTTAGCCTGG

GCTGTAGCTATTATAAACCGGCAGGAGATTGGTGGACCTCGCTCTTATACCATCGCAGTT

GCTTCCCTGGGTAAAGGAGTGGCCTGTAATCCTGCCTGCTTCATCACACAGCTCCTCCCT

GTGAAAAGGAAGCTAGGGTTCTATAACTGGACTTCAAGGTTAAAAAGTCACATAAATCC

CACAGGCACTGTTTTGCTTCAGCTAGAAAATACAATGCAGATGTCATTAAAAGACTTACT

T

Polypeptide Sequence of Variant No. 218:

(SEQ ID NO: 13)
LDNGLARTPTMGWLHWERFMCNLDCQEEPDSCISEKLFMEMAELMVSEGW

KDAGYEYLCIDDCWMAPQRDSEGRLQADPQRFPHGIRQLANYVHSKGLKL

GIYADVGNKTCAGFPGSFGYYDIDAQTFADWGVDLLKFDGCYCDSLENLA

-continued

DGYKHMSLALNRTGRSIVYSCEWPLYMWPFQKPNYTEIRQYCNHWRNFAD

IDDSWASIKSILDWTSFNQERIVDVAGPGGWNDPDMLVIGNFGLSWNQQV

TQMALWAIMAAPLFMSNDLRHISPQAKALLQDKDVIAINQDPLGKQGYQL

RQGDNFEVWERPLSGLAWAVAIINRQEIGGPRSYTIAVASLGKGVACNPA

CFITQLLPVKRKLGFYNVVTSRLKSHINPTGTVLLQLENTMQMSLKDLL

Polynucleotide Sequence of Variant No. 326 yCDS:

(SEQ ID NO: 14)
TTGGATAACGGGTTAGCCCGTACACCTACTATGGGTTGGCTTCACTGGGAAAGATTCATG

TGTAACTTAGATTGCCAAGAAGAGCCTGACAGCTGTATCTCAGAGAAACTATTCATGGA

GATGGCTGAACGGATGGTAAGTGAAGGATGGAAGGATGCTGGTTATGAATACCTATGTA

TTGATGATTGCTGGATGGCTCCACAGCGTGATTCAGAAGGTAGGTTACAAGCTGACCCCC

AGAGATTCCCACATGGCATACGTCAGCTTGCAAACTACGTACACAGCAAAGGTCTAAAG

TTAGGCATCTACGCTGATGTCGGAAACAAGACATGTGCTGGTTTCCCAGGTTCATTCGGT

TACTATGACATAGATGCGCAGACGTTTGCTGATTGGGGTGTTGATTTGTTGAAGTTTGAT

GGATGCTACTGCGATTCCCTGGAGAACCTAGCCGATGGGTACAAACACATGAGTTTGGCT

CTAAACAGGACTGGTAGGAGCATCGTCTATAGTTGTGAATGGCCCTTGTACATGTGGCCG

TTTCAGAAGCCAAACTACACTGAGATAAGACAATACTGTAACCATTGGCGTAACTTTGCT

```
GACATAGATGATTCATGGGCTTCAATCAAATCTATCTTGGATTGGACTTCTCGTAACCAG

GAAAGAATTGTTGATGTTGCAGGTCCAGGTGGATGGAATGACCCTGATATGCTTGTCATA

GGGAACTTTGGGCTATCATGGGACCAACAAGTTACACAAATGGCTTTGTGGGCGATCAT

GGCCGCACCCCTATTCATGTCTAATGATCTACGTCACATATCACCCCAAGCAAAGGCTTT

ACTTCAAGATAAGGATGTCATAGCGATCAACCAAGATCCTCTTGGTAAACAAGGTTATCA

ATTGAGAAAAGGTGACAACTTTGAAGTGTGGGAAAGACCATTGTCTGGAGATGCGTGGG

CTGTTGCTATTATCAACCGTCAAGAGATCGGAGGGCCAAGATCTTACACTATCCCGGTAG

CCTCTTTGGGTAAGGGTGTTGCGTGCAATCCTGCCTGCTTCATTACACAATTGCTTCCAGT

TAAGAGACAATTGGGTTTCTATAACTGGACCTCTAGGCTAAAAAGTCACATTAATCCTAC

TGGTACGGTATTGTTGCAATTGGAGAACACAATGCAAATGTCTTTGAAAGATTTGTTA
```

Polypeptide Sequence of Variant No. 326:

(SEQ ID NO: 15)
```
LDNGLARTPTMGWLHWERFMCNLDCQEEPDSCISEKLFMEMAERMVSEGW

KDAGYEYLCIDDCWMAPQRDSEGRLQADPQRFPHGIRQLANYVHSKGLKL

GIYADVGNKTCAGFPGSFGYYDIDAQTFADWGVDLLKFDGCYCDSLENLA

DGYKHMSLALNRTGRSIVYSCEWPLYMWPFQKPNYTEIRQYCNHWRNFAD

IDDSWASIKSILDWTSRNQERIVDVAGPGGWNDPDMLVIGNFGLSWDQQV

TQMALWAIMAAPLFMSNDLRHISPQAKALLQDKDVIAINQDPLGKQGYQL

RKGDNFEVWERPLSGDAWAVAIINRQEIGGPRSYTIPVASLGKGVACNPA

CFITQLLPVKRQLGFYNVVTSRLKSHINPTGTVLLQLENTMQMSLKDLL
```

Polynucleotide Sequence of Variant No. 206 yCDS:

(SEQ ID NO: 16)
```
TTGGATAACGGGTTAGCCCGTACACCTACTATGGGTTGGCTTCACTGGGAAAGATTCATG

TGTAACTTAGATTGCCAAGAAGAGCCTGACAGCTGTATCTCAGAGAAACTATTCATGGA

GATGGCTGAACTAATGGTAAGTGAAGGATGGAAGGATGCTGGTTATGAATACCTATGTA

TTGATGATTGCTGGATGGCTCCACAGCGTGATTCAGAAGGTAGGTTACAAGCTGACCCCC

AGAGATTCCCACATGGCATACGTCAGCTTGCAAACTACGTACACAGCAAGGGTCTAAAG

TTAGGCATCTACGCTGATGTCGGAAACAAGACATGTGCTGGTTTCCCAGGTTCATTCGGT

TACTATGACATAGATGCGCAGACGTTTGCTGATTGGGGTGTTGATTTGTTGAAGTTTGAT

GGATGCTACTGCGATTCCCTGGAGAACCTAGCCGATGGGTACAAACACATGAGTTTGGCT

CTAAACAGGACTGGTAGGAGCATCGTCTATAGTTGTGAATGGCCCTTGTACATGTGGCCG

TTTCAGAAGCCAAACTACACTGAGATAAGACAATACTGTAACCATTGGCGTAACTTTGCT

GACATAGATGATTCATGGGCTTCAATCAAATCTATCTTGGATTGGACTTCTTTCAACCAG

GAAAGAATTGTTGATGTTGCAGGTCCAGGTGGATGGAATGACCCTGATATGCTTGTCATA

GGGAACTTTGGGCTATCATGGAATCAACAAGTTACACAAATGGCTTTGTGGGCGATCATG

GCCGCACCCCTATTCATGTCTAATGATCTACGTCACATATCACCCCAAGCAAAGGCTTTA

CTTCAAGATAAGGATGTCATAGCGATCAACCAAGATCCTCTTGGTAAACAAGGTTATCAA

TTGAGACAAGGTGACAACTTTGAAGTGTGGGAAAGACCATTGTCTGGACTTGCGTGGGC

TGTTGCTATGATCAACCGTCAAGAGATCGGAGGGCCAAGATCTTACACTATCGCGGTAGC

CTCTTTGGGTAAGGGTGTTGCGTGCAATCCTGCCTGCTTCATTACACAATTGCTTCCAGTT

AAGAGAAAGTTGGGTTTCTATAATTGGACCTCTAGGCTAAGAAGTCACATCAATCCTACT

GGTACGGTATTGTTGCAATTGGAGAACACAATGCAAATGTCTTTGAAAGATTTGTTA
```

Polynucleotide Sequence of Variant No. 206 hCDS:

(SEQ ID NO: 17)
CTGGACAATGGATTGGCAAGGACGCCTACCATGGGCTGGCTGCACTGGGA

GCGCTTCATGTGCAACCTTGACTGCCAGGAAGAGCCAGATTCCTGCATCA

GTGAGAAGCTCTTCATGGAGATGGCAGAGCTCATGGTCTCAGAAGGCTGG

AAGGATGCAGGTTATGAGTACCTCTGCATTGATGACTGTTGGATGGCTCC

CCAAAGAGATTCAGAAGGCAGACTTCAGGCAGACCCTCAGCGCTTTCCTC

ATGGGATTCGCCAGCTAGCTAATTATGTTCACAGCAAAGGACTGAAGCTA

GGGATTTATGCAGATGTTGGAAATAAAACCTGCGCAGGCTTCCCTGGGAG

TTTTGGATACTACGACATTGATGCCCAGACCTTTGCTGACTGGGGAGTAG

ATCTGCTAAAATTTGATGGTTGTTACTGTGACAGTTTGGAAAATTTGGCA

GATGGTTATAAGCACATGTCCTTGGCCCTGAATAGGACTGGCAGAAGCAT

TGTGTACTCCTGTGAGTGGCCTCTTTATATGTGGCCCTTTCAAAAGCCCA

ATTATACAGAAATCCGACAGTACTGCAATCACTGGCGAAATTTTGCTGAC

ATTGATGATTCCTGGGCGAGTATAAAGAGTATCTTGGACTGGACATCTTT

TAACCAGGAGAGAATTGTTGATGTTGCTGGACCAGGGGGTTGGAATGACC

CAGATATGTTAGTGATTGGCAACTTTGGCCTCAGCTGGAATCAGCAAGTA

ACTCAGATGGCCCTCTGGGCTATCATGGCTGCTCCTTTATTCATGTCTAA

TGACCTCCGACACATCAGCCCTCAAGCCAAAGCTCTCCTTCAGGATAAGG

ACGTAATTGCCATCAATCAGGACCCCTTGGGCAAGCAAGGGTACCAGCTT

AGACAGGGAGACAACTTTGAAGTGTGGGAACGACCTCTCTCAGGCTTAGC

CTGGGCTGTAGCTATGATAAACCGGCAGGAGATTGGTGGACCTCGCTCTT

ATACCATCGCAGTTGCTTCCCTGGGTAAAGGAGTGGCCTGTAATCCTGCC

TGCTTCATCACACAGCTCCTCCCTGTGAAAAGGAAGCTAGGGTTCTATAA

CTGGACTTCAAGGTTAAGAAGTCACATAAATCCCACAGGCACTGTTTTGC

TTCAGCTAGAAAATACAATGCAGATGTCATTAAAAGACTTACTT

Polypeptide Sequence of Variant No. 206:

(SEQ ID NO: 18)
LDNGLARTPTMGWLHWERFMCNLDCQEEPDSCISEKLFMEMAELMVSEGW

KDAGYEYLCIDDCWMAPQRDSEGRLQADPQRFPHGIRQLANYVHSKGLKL

GIYADVGNKTCAGFPGSFGYYDIDAQTFADWGVDLLKFDGCYCDSLENLA

DGYKHMSLALNRTGRSIVYSCEWPLYMWPFQKPNYTEIRQYCNHWRNFAD

IDDSWASIKSILDWTSFNQERIVDVAGPGGWNDPDMLVIGNFGLSWNQQV

TQMALWAIMAAPLFMSNDLRHISPQAKALLQDKDVIAINQDPLGKQGYQL

RQGDNFEVWERPLSGLAWAVAMINRQEIGGPRSYTIAVASLGKGVACNPA

CFITQLLPVKRKLGFYNVVTSRLRSHINPTGTVLLQLENTMQMSLKDLL

Polynucleotide Sequence of Variant No. 205 yCDS:

(SEQ ID NO: 19)
TTGGATAACGGGTTAGCCCGTACACCTACTATGGGTTGGCTTCACTGGGA

AAGATTCATGTGTAACTTAGATTGCCAAGAAGAGCCTGACAGCTGTATCT

CAGAGAAACTATTCATGGAGATGGCTGAACTAATGGTAAGTGAAGGATGG

AAGGATGCTGGTTATGAATACCTATGTATTGATGATTGCTGGATGGCTCC

ACAGCGTGATTCAGAAGGTAGGTTACAAGCTGACCCCCAGAGATTCCCAC

ATGGCATACGTCAGCTTGCAAACTACGTACACAGCAAGGGTCTAAAGTTA

GGCATCTACGCTGATGTCGGAAACAAGACATGTGCTGGTTTCCCAGGTTC

ATTCGGTTACTATGACATAGATGCGCAGACGTTTGCTGATTGGGGTGTTG

ATTTGTTGAAGTTTGATGGATGCTACTGCGATTCCCTGGAGAACCTAGCC

GATGGGTACAAACACATGAGTTTGGCTCTAAACAGGACTGGTAGGAGCAT

CGTCTATAGTTGTGAATGGCCCTTGTACATGTGGCCGTTTCAGAAGCCAA

ACTACACTGAGATAAGACAATACTGTAACCATTGGCGTAACTTTGCTGAC

ATAGATGATTCATGGGCTTCAATCAAATCTATCTTGGATTGGACTTCTTT

CAACCAGGAAAGAATTGTTGATGTTGCAGGTCCAGGTGGATGGAATGACC

CTGATATGCTTGTCATAGGGAACTTTGGGCTATCATGGAATCAACAAGTT

ACACAAATGGCTTTGTGGGCGATCATGGCCGCACCCCTATTCATGTCTAA

TGATCTACGTCACATATCACCCCAAGCAAAGGCTTTACTTCAAGATAAGG

ATGTCATAGCGATCAACCAAGATCCTCTTGGTAAACAAGGTTATCAATTG

AGACAAGGTGACAACTTTGAAGTGTGGGAAAGACCATTGTCTGGACTTGC

GTGGGCTGTTGCTATGATCAACCGTCAAGAGATCGGAGGGCCAAGATCTT

ACACTATCGCGGTAGCCTCTTTGGGTAAGGGTGTTGCGTGCAATCCTGCC

TGCTTCATTACACAATTGCTTCCAGTTAAGAGAAAGTTGGGTTTCTATGA

TTGGGACTCTAGGCTAAGAAGTCACATCAATCCTACTGGTACGGTATTGT

TGCAATTGGAGAACACAATGCAAATGTCTTTGAAAGATTTGTTA

Polynucleotide Sequence of Variant No. 205 hCDS:

(SEQ ID NO: 20)
CTGGACAATGGATTGGCAAGGACGCCTACCATGGGCTGGCTGCACTGGGA

GCGCTTCATGTGCAACCTTGACTGCCAGGAAGAGCCAGATTCCTGCATCA

GTGAGAAGCTCTTCATGGAGATGGCAGAGCTCATGGTCTCAGAAGGCTGG

AAGGATGCAGGTTATGAGTACCTCTGCATTGATGACTGTTGGATGGCTCC

CCAAAGAGATTCAGAAGGCAGACTTCAGGCAGACCCTCAGCGCTTTCCTC

ATGGGATTCGCCAGCTAGCTAATTATGTTCACAGCAAAGGACTGAAGCTA

GGGATTTATGCAGATGTTGGAAATAAAACCTGCGCAGGCTTCCCTGGGAG

TTTTGGATACTACGACATTGATGCCCAGACCTTTGCTGACTGGGGAGTAG

ATCTGCTAAAATTTGATGGTTGTTACTGTGACAGTTTGGAAAATTTGGCA

GATGGTTATAAGCACATGTCCTTGGCCCTGAATAGGACTGGCAGAAGCAT

TGTGTACTCCTGTGAGTGGCCTCTTTATATGTGGCCCTTTCAAAAGCCCA

ATTATACAGAAATCCGACAGTACTGCAATCACTGGCGAAATTTTGCTGAC

ATTGATGATTCCTGGGCGAGTATAAAGAGTATCTTGGACTGGACATCTTT

TAACCAGGAGAGAATTGTTGATGTTGCTGGACCAGGGGGTTGGAATGACC

CAGATATGTTAGTGATTGGCAACTTTGGCCTCAGCTGGAATCAGCAAGTA

ACTCAGATGGCCCTCTGGGCTATCATGGCTGCTCCTTTATTCATGTCTAA

-continued
TGACCTCCGACACATCAGCCCTCAAGCCAAAGCTCTCCTTCAGGATAAGG
ACGTAATTGCCATCAATCAGGACCCCTTGGGCAAGCAAGGGTACCAGCTT
AGACAGGGAGACAACTTTGAAGTGTGGGAACGACCTCTCTCAGGCTTAGC
CTGGGCTGTAGCTATGATAAACCGGCAGGAGATTGGTGGACCTCGCTCTT
ATACCATCGCAGTTGCTTCCCTGGGTAAAGGAGTGGCCTGTAATCCTGCC
TGCTTCATCACACAGCTCCTCCCTGTGAAAAGGAAGCTAGGGTTCTATGA
TTGGGATTCAAGGTTAAGAAGTCACATAAATCCCACAGGCACTGTTTTGC
TTCAGCTAGAAAATACAATGCAGATGTCATTAAAAGACTTACTT Polypeptide Sequence of Variant No. 205:

(SEQ ID NO: 21)
LDNGLARTPTMGWLHWERFMCNLDCQEEPDSCISEKLFMEMAELMVSEGW
KDAGYEYLCIDDCWMAPQRDSEGRLQADPQRFPHGIRQLANYVHSKGLKL
GIYADVGNKTCAGFPGSFGYYDIDAQTFADWGVDLLKFDGCYCDSLENLA
DGYKHMSLALNRTGRSIVYSCEWPLYMWPFQKPNYTEIRQYCNHWRNFAD
IDDSWASIKSILDWTSFNQERIVDVAGPGGWNDPDMLVIGNFGLSWNQQV
TQMALWAIMAAPLFMSNDLRHISPQAKALLQDKDVIAINQDPLGKQGYQL
RQGDNFEVWERPLSGLAWAVAMINRQEIGGPRSYTIAVASLGKGVACNPA
CFITQLLPVKRKLGFYDWDSRLRSHINPTGTVLLQLENTMQMSLKDLL

Polynucleotide Sequence of Variant No. 76 yCDS:

(SEQ ID NO: 22)
TTGGATAACGGGTTAGCCCGTACACCTACTATGGGTTGGCTTCACTGGGA
AAGATTCATGTGTAACTTAGATTGCCAAGAAGAGCCTGACAGCTGTATCT
CAGAGAAACTATTCATGGAGATGGCTGAACTAATGGTAAGTGAAGGATGG
AAGGATGCTGGTTATGAATACCTATGTATTGATGATTGCTGGATGGCTCC
ACAGCGTGATTCAGAAGGTAGGTTACAAGCTGACCCCCAGAGATTCCCAC
ATGGCATACGTCAGCTTGCAAACTACGTACACAGCAAGGGTCTAAAGTTA
GGCATCTACGCTGATGTCGGAAACAAGACATGTGCTGGTTTCCCAGGTTC
ATTCGGTTACTATGACATAGATGCGCAGACGTTTGCTGATTGGGGTGTTG
ATTTGTTGAAGTTTGATGGATGCTACTGCGATTCCCTGGAGAACCTAGCC
GATGGGTACAAACACATGAGTTTGGCTCTAAACAGGACTGGTAGGAGCAT
CGTCTATAGTTGTGAATGGCCCTTGTACATGTGGCCGTTTCAGAAGCCAA
ACTACACTGAGATAAGACAATACTGTAACCATTGGCGTAACTTTGCTGAC
ATAGATGATTCATGGAGGTCAATCAAATCTATCTTGGATTGGACTTCTTT
CAACCAGGAAAGAATTGTTGATGTTGCAGGTCCAGGTGGATGGAATGACC
CTGATATGCTTGTCATAGGGAACTTTGGGCTATCATGGAATCAACAAGTT
ACACAAATGGCTTTGTGGGCGATCATGGCCGCACCCCTATTCATGTCTAA
TGATCTACGTCACATATCACCCCAAGCAAAGGCTTTACTTCAAGATAAGG
ATGTCATAGCGATCAACCAAGATCCTCTTGGTAAACAAGGTTATCAATTG
AGACAAGGTGACAACTTTGAAGTGTGGGAAAGACCATTGTCTGGACTTGC
GTGGGCTGTTGCTATGATCAACCGTCAAGAGATCGGAGGGCCAAGATCTT

-continued
ACACTATCGCGGTAGCCTCTTTGGGTAAGGGTGTTGCGTGCAATCCTGCC
TGCTTCATTACACAATTGCTTCCAGTTAAGAGAAAGTTGGGTTTCTATGA
GTGGACATCTAGGCTAAGAAGTCACATCAATCCTACTGGTACGGTATTGT
TGCAATTGGAGAACACAATGCAAATGTCTTTGAAAGATTTGTTA Polynucleotide Sequence of Variant No. 76 hCDS:

(SEQ ID NO: 23)
CTGGACAATGGATTGGCAAGGACGCCTACCATGGGCTGGCTGCACTGGGA
GCGCTTCATGTGCAACCTTGACTGCCAGGAAGAGCCCAGATTCCTGCATCA
GTGAGAAGCTCTTCATGGAGATGGCAGAGCTCATGGTCTCAGAAGGCTGG
AAGGATGCAGGTTATGAGTACCTCTGCATTGATGACTGTTGGATGGCTCC
CCAAAGAGATTCAGAAGGCAGACTTCAGGCAGACCCTCAGCGCTTTCCTC
ATGGGATTCGCCAGCTAGCTAATTATGTTCACAGCAAAGGACTGAAGCTA
GGGATTTATGCAGATGTTGGAAATAAAACCTGCGCAGGCTTCCCTGGGAG
TTTTGGATACTACGACATTGATGCCCAGACCTTTGCTGACTGGGGAGTAG
ATCTGCTAAAATTTGATGGTTGTTACTGTGACAGTTTGGAAAATTTGGCA
GATGGTTATAAGCACATGTCCTTGGCCCTGAATAGGACTGGCAGAAGCAT
TGTGTACTCCTGTGAGTGGCCTCTTTATATGTGGCCCTTTCAAAAGCCCA
ATTATACAGAAATCCGACAGTACTGCAATCACTGGCGAAATTTTGCTGAC
ATTGATGATTCCTGGCGTAGTATAAAGAGTATCTTGGACTGGACATCTTT
TAACCAGGAGAGAATTGTTGATGTTGCTGGACCAGGGGGTTGGAATGACC
CAGATATGTTAGTGATTGGCAACTTTGGCCTCAGCTGGAATCAGAAGTA
ACTCAGATGGCCCTCTGGGCTATCATGGCTGCTCCTTTATTCATGTCTAA
TGACCTCCGACACATCAGCCCTCAAGCCAAAGCTCTCCTTCAGGATAAGG
ACGTAATTGCCATCAATCAGGACCCCTTGGGCAAGCAAGGGTACCAGCTT
AGACAGGGAGACAACTTTGAAGTGTGGGAACGACCTCTCTCAGGCTTAGC
CTGGGCTGTAGCTATGATAAACCGGCAGGAGATTGGTGGACCTCGCTCTT
ATACCATCGCAGTTGCTTCCCTGGGTAAAGGAGTGGCCTGTAATCCTGCC
TGCTTCATCACACAGCTCCTCCCTGTGAAAAGGAAGCTAGGGTTCTATGA
ATGGACTTCAAGGTTAAGAAGTCACATAAATCCCACAGGCACTGTTTTGC
TTCAGCTAGAAAATACAATGCAGATGTCATTAAAAGACTTACTT

Polypeptide Sequence of Variant No. 76:

(SEQ ID NO: 24)
LDNGLARTPTMGWLHWERFMCNLDCQEEPDSCISEKLFMEMAELMVSEGW
KDAGYEYLCIDDCWMAPQRDSEGRLQADPQRFPHGIRQLANYVHSKGLKL
GIYADVGNKTCAGFPGSFGYYDIDAQTFADWGVDLLKFDGCYCDSLENLA
DGYKHMSLALNRTGRSIVYSCEWPLYMWPFQKPNYTEIRQYCNHWRNFAD
IDDSWRSIKSILDWTSFNQERIVDVAGPGGWNDPDMLVIGNFGLSWNQQV
TQMALWAIMAAPLFMSNDLRHISPQAKALLQDKDVIAINQDPLGKQGYQL
RQGDNFEVWERPLSGLAWAVAMINRQEIGGPRSYTIAVASLGKGVACNPA
CFITQLLPVKRKLGFYEWTSRLRSHINPTGTVLLQLENTMQMSLKDLL

Polynucleotide Sequence of Mfalpha signal peptide:

(SEQ ID NO: 25)
ATGAGATTTCCTTCAATTTTTACTGCAGTTTTATTCGCAGCATCCTCCGC
ATTAGCT

Polypeptide Sequence of Mfalpha Signal Peptide:

(SEQ ID NO: 26)
MRFPSIFTAVLFAASSALA

Polynucleotide Sequence of MMO435:

(SEQ ID NO: 27)
ttaactatatcgtaatacacaggatccaccATGAGATTTCCTTCAATTTT
TACTG

Polynucleotide Sequence of MMO439:

(SEQ ID NO: 28)
AGTAGGTGTACGGGCTAACCCGTTATCCAAAGCTAATGCGGAGGATGC

Polynucleotide Sequence of MMO514:

(SEQ ID NO: 29)
TTTTACTGCAGTTTTATTCGCAGCATCCTCCGCATTAGCTTTGGATAACG
GGTTAGCCCG

Polynucleotide Sequence of MMO481:

(SEQ ID NO: 30)
GAGCTAAAAGTACAGTGGGAACAAAGTCGAGGTCGACTTATAACAAATCT
TTCAAAGACA

Polynucleotide Sequence of Synthetic Mammalian Signal Peptide:

(SEQ ID NO: 31)
ATGGAATGGAGCTGGGTCTTTCTCTTCTTCCTGTCAGTAACGACTGGTGT
CCACTCC

Polynucleotide Sequence of LAKE Fw:

CGATCGAAGCTTCGCCACCA     (SEQ ID NO. 32)

Polynucleotide Sequence of Br Reverse:

(SEQ ID NO: 33)
CTTGCCAATCCATTGTCCAGGGAGTGGACACCAGTCGTTA

Polynucleotide Sequence of Br Fw:

(SEQ ID NO: 34)
TAACGACTGGTGTCCACTCCCTGGACAATGGATTGGCAAG

Polynucleotide Sequence of hGLA Rv:

(SEQ ID NO: 35)
CGATCGGCGGCCGCTCAAAGTAAGTCTTTTAATGACA

Polynucleotide Sequence of SP-GLA (yCDS):

(SEQ ID NO: 36)
ATGAGATTTCCTTCAATTTTTACTGCAGTTTTATTCGCAGCATCCTCCGC
ATTAGCTTTGGATAACGGGTTAGCCCGTACACCTACTATGGGTTGGCTTC
ACTGGGAAAGATTCATGTGTAACTTAGATTGCCAAGAAGAGCCTGACAGC
TGTATCTCAGAGAAACTATTCATGGAGATGGCTGAACTAATGGTAAGTGA
AGGATGGAAGGATGCTGGTTATGAATACCTATGTATTGATGATTGCTGGA
TGGCTCCACAGCGTGATTCAGAAGGTAGGTTACAAGCTGACCCCCAGAGA
TTCCCACATGGCATACGTCAGCTTGCAAACTACGTACACAGCAAGGGTCT
AAAGTTAGGCATCTACGCTGATGTCGGAAACAAGACATGTGCTGGTTTCC
CAGGTTCATTCGGTTACTATGACATAGATGCGCAGACGTTTGCTGATTGG
GGTGTTGATTTGTTGAAGTTTGATGGATGCTACTGCGATTCCCTGGAGAA
CCTAGCCGATGGGTACAAACACATGAGTTTGGCTCTAAACAGGACTGGTA
GGAGCATCGTCTATAGTTGTGAATGGCCCTTGTACATGTGGCCGTTTCAG
AAGCCAAACTACACTGAGATAAGACAATACTGTAACCATTGGCGTAACTT
TGCTGACATAGATGATTCATGGAAGTCAATCAAATCTATCTTGGATTGGA
CTTCTTTCAACCAGGAAAGAATTGTTGATGTTGCAGGTCCAGGTGGATGG
AATGACCCTGATATGCTTGTCATAGGGAACTTTGGGCTATCATGGAATCA
ACAAGTTACACAAATGGCTTTGTGGGCGATCATGGCCGCACCCCTATTCA
TGTCTAATGATCTACGTCACATATCACCCCAAGCAAAGGCTTTACTTCAA
GATAAGGATGTCATAGCGATCAACCAAGATCCTCTTGGTAAACAAGGTTA
TCAATTGAGACAAGGTGACAACTTTGAAGTGTGGGAAAGACCATTGTCTG
GACTTGCGTGGGCTGTTGCTATGATCAACCGTCAAGAGATCGGAGGGCCA
AGATCTTACACTATCGCGGTAGCCTCTTTGGGTAAGGGTGTTGCGTGCAA
TCCTGCCTGCTTCATTACACAATTGCTTCCAGTTAAGAGAAAGTTGGGTT
TCTATGAGTGGACATCTAGGCTAAGAAGTCACATCAATCCTACTGGTACG
GTATTGTTGCAATTGGAGAACACAATGCAAATGTCTTTGAAAGATTTGTT
A

Polynucleotide Sequence of MFleader-GLA (yCDS):

(SEQ ID NO: 37)
ATGAGATTTCCTTCAATTTTTACTGCAGTTTTATTCGCAGCATCCTCCGC
ATTAGCTGCTCCAGTCAACACTACAACAGAAGATGAAACGGCACAAATTC
CGGCTGAAGCTGTCATCGGTTACTTAGATTTAGAAGGGGATTTCGATGTT
GCTGTTTTGCCATTTTCCAACAGCACAAATAACGGGTTATTGTTTATAAA
TACTACTATTGCCAGCATTGCTGCTAAAGAAGAAGGGGTATCTTTGGATA
AAAGATTGGATAACGGGTTAGCCCGTACACCTACTATGGGTTGGCTTCAC
TGGGAAAGATTCATGTGTAACTTAGATTGCCAAGAAGAGCCTGACAGCTG
TATCTCAGAGAAACTATTCATGGAGATGGCTGAACTAATGGTAAGTGAAG
GATGGAAGGATGCTGGTTATGAATACCTATGTATTGATGATTGCTGGATG
GCTCCACAGCGTGATTCAGAAGGTAGGTTACAAGCTGACCCCCAGAGATT
CCCACATGGCATACGTCAGCTTGCAAACTACGTACACAGCAAGGGTCTAA

AGTTAGGCATCTACGCTGATGTCGGAAACAAGACATGTGCTGGTTTCCCA
GGTTCATTCGGTTACTATGACATAGATGCGCAGACGTTTGCTGATTGGG
TGTTGATTTGTTGAAGTTTGATGGATGCTACTGCGATTCCCTGGAGAACC
TAGCCGATGGGTACAAACACATGAGTTTGGCTCTAAACAGGACTGGTAGG
AGCATCGTCTATAGTTGTGAATGGCCCTTGTACATGTGGCCGTTTCAGAA
GCCAAACTACACTGAGATAAGACAATACTGTAACCATTGGCGTAACTTTG
CTGACATAGATGATTCATGGAAGTCAATCAAATCTATCTTGGATTGGACT
TCTTTCAACCAGGAAAGAATTGTTGATGTTGCAGGTCCAGGTGGATGGAA
TGACCCTGATATGCTTGTCATAGGGAACTTTGGGCTATCATGGAATCAAC
AAGTTACACAAATGGCTTTGTGGGCGATCATGGCCGCACCCCTATTCATG
TCTAATGATCTACGTCACATATCACCCCAAGCAAAGGCTTTACTTCAAGA
TAAGGATGTCATAGCGATCAACCAAGATCCTCTTGGTAAACAAGGTTATC
AATTGAGACAAGGTGACAACTTTGAAGTGTGGGAAAGACCATTGTCTGGA
CTTGCGTGGGCTGTTGCTATGATCAACCGTCAAGAGATCGGAGGGCAAG
ATCTTACACTATCGCGGTAGCCTCTTTGGGTAAGGGTGTTGCGTGCAATC
CTGCCTGCTTCATTACACAATTGCTTCCAGTTAAGAGAAAGTTGGGTTTC
TATGAGTGGACATCTAGGCTAAGAAGTCACATCAATCCTACTGGTACGGT
ATTGTTGCAATTGGAGAACACAATGCAAATGTCTTTGAAAGATTTGTTA

Polypeptide Sequence of MFleader:

(SEQ ID NO: 38)
MRFPSIFTAVLFAASSALAAPVNTTTEDETAQIPAEAVIGYLDLEGDFDV

AVLPFSNSTNNGLLFINTTIASIAAKEEGVSLDKR

Polynucleotide Sequence of Variant No. 395 yCDS:

(SEQ ID NO: 39)
TTGGATAACGGGTTAGCCCGTACACCTACTATGGGTTGGCTTCACTGGGA

AAGATTCATGTGTAACTTAGATTGCCAAGAAGAGCCTGACAGCTGTATCT

CAGAGAAACTATTCATGGAGATGGCTGAACGGATGGTAAGTGAAGGATGG

AAGGATGCTGGTTATGAATACCTATGTATTGATGATTGCTGGATGGCTCC

ACAGCGTGATTCAGAAGGTAGGTTACAAGCTGACCCCCAGAGATTCCCAC

ATGGCATACGTCAGCTTGCAAACCATGTACACAGCAAAGGTCTAAAGTTA

GGCATCTACGCTGATGTCGGAAACAAGACATGTGCTGGTTTCCCAGGTTC

ATTCGGTTACTATGACATAGATGCGCAGACGTTTGCTGATTGGGGTGTTG

ATTTGTTGAAGTTTGATGGATGCTACTGCGATTCCCTGGAGAACCTAGCC

GATGGGTACAAACACATGAGTTTGGCTCTAAACAGGACTGGTAGGAGCAT

CGTCTATAGTTGTGAATGGCCCTTGTACATGTGGCCGTTTCAGAAGCCAA

ACTACACTGAGATAAGACAATACTGTAACCATTGGCGTAACTTTGCTGAC

ATAGATGATTCATGGGCTTCAATCAAATCTATCTTGGATTGGACTTCTCG

TAACCAGGAAAGAATTGTTGATGTTGCAGGTCCAGGTGGATGGAATGACC

CTGATATGCTTGTCATAGGGAACTTTGGGCTATCATGGGACCAACAAGTT

ACACAAATGGCTTTGTGGGCGATCATGGCCGCACCCCTATTCATGTCTAA

TGATCTACGTCACATATCACCCCAAGCAAAGGCTTTACTTCAAGATAAGG

ATGTCATAGCGATCAACCAAGATCCTCTTGGTAAACAAGGTTATCAATTG

AGAAAAGGTGACAACTTTGAAGTGTGGGAAAGACCATTGTCTGGAGATGC

GTGGGCTGTTGCTATTATCAACCGTCAAGAGATCGGAGGGCAAGATCTT

ACACTATCCCGGTAGCCTCTTTGGGTAAGGGTGTTGCGTGCAATCCTGCC

TGCTTCATTACACAATTGCTTCCAGTTAAGAGACAATTGGGTTTCTATAA

CTGGACCTCTAGGCTAAAAGTCACATTAATCCTACTGGTACGGTATTGT

TGCAATTGGAGAACACAATGCAAATGTCTTTGAAAGATTTGTTA

Polypeptide Sequence of Variant No. 395:

(SEQ ID NO: 40)
LDNGLARTPTMGWLHWERFMCNLDCQEEPDSCISEKLFMEMAERMVSEGW

KDAGYEYLCIDDCWMAPQRDSEGRLQADPQRFPHGIRQLANHVHSKGLKL

GIYADVGNKTCAGFPGSFGYYDIDAQTFADWGVDLLKFDGCYCDSLENLA

DGYKHMSLALNRTGRSIVYSCEWPLYMWPFQKPNYTEIRQYCNHWRNFAD

IDDSWASIKSILDWTSRNQERIVDVAGPGGWNDPDMLVIGNFGLSWDQQV

TQMALWAIMAAPLFMSNDLRHISPQAKALLQDKDVIAINQDPLGKQGYQL

RKGDNFEVWERPLSGDAWAVAIINRQEIGGPRSYTIPVASLGKGVACNPA

CFITQLLPVKRQLGFYNWTSRLKSHINPTGTVLLQLENTMQMSLKDLL

Polynucleotide Sequence of Variant No. 402 yCDS:

(SEQ ID NO: 41)
TTGGATAACGGGTTAGCCCGTACACCTACTATGGGTTGGCTTCACTGGGA

AAGATTCATGTGTAACTTAGATTGCCAAGAAGAGCCTGACAGCTGTATCT

CAGAGAAACTATTCATGGAGATGGCTGAACGGATGGTAAGTGAAGGATGG

AAGGATGCTGGTTATGAATACCTATGTATTGATGATTGCTGGATGGCTCC

ACAGCGTGATTCAGAAGGTAGGTTACAAGCTGACCCCCAGAGATTCCCAC

ATGGCATACGTCAGCTTGCAAACCATGTACACAGCAAAGGTCTAAAGTTA

GGCATCTACGCTGATGTCGGAAACAAGACATGTGCTGGTTTCCCAGGTTC

ATTCGGTTACTATGACATAGATGCGCAGACGTTTGCTGATTGGGGTGTTG

ATTTGTTGAAGTTTGATGGATGCTACTGCGATTCCCTGGAGAACCTAGCC

GATGGGTACAAACACATGAGTTTGGCTCTAAACAGGACTGGTAGGCCGAT

CGTCTATAGTTGTGAATGGCCCTTGTACATGTGGCCGTTTCAGAAGCCAA

ACTACACTGAGATAAGACAATACTGTAACCATTGGCGTAACTTTGCTGAC

ATAGATGATTCATGGGCTTCAATCAAATCTATCTTGGATTGGACTTCTCG

TAACCAGGAAAGAATTGTTGATGTTGCAGGTCCAGGTGGATGGAATGACC

CTGATATGCTTGTCATAGGGAACTTTGGGCTATCATGGGACCAACAAGTT

ACACAAATGGCTTTGTGGGCGATCATGGCCGCACCCCTATTCATGTCTAA

TGATCTACGTCACATATCACCCCAAGCAAAGGCTTTACTTCAAGATAAGG

ATGTCATAGCGATCAACCAAGATCCTCTTGGTAAACAAGGTTATCAATTG

AGAAAAGGTGACAACTTTGAAGTGTGGGAAAGACCATTGTCTGGAGATGC

GTGGGCTGTTGCTATTATCAACCGTCAAGAGATCGGAGGGCAAGATCTT

-continued

ACACTATCCCGGTAGCCTCTTTGGGTAAGGGTGTTGCGTGCAATCCTGCC

TGCTTCATTACACAATTGCTTCCAGTTAAGAGACAATTGGGTTTCTATAA

CTGGACCTCTAGGCTAAAAAGTCACATTAATCCTACTGGTACGGTATTGT

TGCAATTGGAGAACACAATGCAAATGTCTTTGAAAGATTTGTTA

Polypeptide Sequence of Variant No. 402:

(SEQ ID NO: 42)
LDNGLARTPTMGWLHWERFMCNLDCQEEPDSCISEKLFMEMAERMVSEGW

KDAGYEYLCIDDCWMAPQRDSEGRLQADPQRFPHGIRQLANYVHSKGLKL

GIYADVGNKTCAGFPGSFGYYDIDAQTFADWGVDLLKFDGCYCDSLENLA

DGYKHMSLALNRTGRPIVYSCEWPLYMWPFQKPNYTEIRQYCNHWRNFAD

IDDSWASIKSILDWTSRNQERIVDVAGPGGWNDPDMLVIGNFGLSWDQQV

TQMALWAIMAAPLFMSNDLRHISPQAKALLQDKDVIAINQDPLGKQGYQL

RKGDNFEVWERPLSGDAWAVAIINRQEIGGPRSYTIPVASLGKGVACNPA

CFITQLLPVKRQLGFYNWTSRLKSHINPTGTVLLQLENTMQMSLKDLL

Polynucleotide Sequence of Variant No. 625 yCDS:

(SEQ ID NO: 43)
TTGGATAACGGGTTAGCCCGTACACCTACTATGGGTTGGCTTCACTGGGA

AAGATTCATGTGTAACTTAGATTGCCAAGAAGAGCCTGACAGCTGTATCT

CAGAGAAACTATTCATGGAGATGGCTGAACGGATGGTAACCGAAGGATGG

AAGGATGCTGGTTATGAATACCTATGTATTGATGATTGCTGGATGGCTCC

ACAGCGTGATTCAGAAGGTAGGTTACAAGCTGACCCCCAGAGATTCCCAC

ATGGCATACGTCAGCTTGCAAACCATGTACACAGCAAAGGTCTAAAGTTA

GGCATCTACGCTGATGTCGGAAACAAGACATGTGCTGGTTTCCCAGGTTC

ATTCGGTTACTATGACATAGATGCGCAGACGTTTGCTGATTGGGGTGTTG

ATTTGTTGAAGTTTGATGGATGCTACTGCGATTCCCTGGAGAACCTAGCC

GATGGGTACAAACACATGAGTTTGGCTCTAAACAGGACTGGTAGGCCGAT

CGTCTATAGTTGTGAATGGCCCTTGTACATGTGGCCGTTTCAGAAGCCAA

ACTACACTGAGATAAGACAATACTGTAACCATTGGCGTAACTTTGCTGAC

ATAGATGATTCATGGGCTTCAATCAAATCTATCTTGGATTGGACTTCTCG

TAACCAGGAAAGAATTGTTGATGTTGCAGGTCCAGGTGGATGGAATGACC

CTGATATGCTTGTCATAGGGAACTTTGGGCTATCATGGGACCAACAAGTT

ACACAAATGGCTTTGTGGGCGATCATGGCCGCACCCCTATTCATGTCTAA

TGATCTACGTGCGATATCACCCCAAGCAAAGGCTTTACTTCAAGATAAGG

ATGTCATAGCGATCAACCAAGATCCTCTTGGTAAACAAGGTTATCAATTG

AGAAAAGGTGACAACTTTGAAGTGTGGGAAAGACCATTGTCTGGAGATGC

GTGGGCTGTTGCTATTATCAACCGTCAAGAGATCGGAGGGCCAAGATCTT

ACACTATCCCGGTAGCCTCTTTGGGTAAGGGTGTTGCGTGCAATCCTGCC

TGCTTCATTACACAATTGCTTCCAGTTAAGAGACAATTGGGTTTCTATAA

CTGGACCTCTAGGCTAAAAAGTCACATTAATCCTACTGGTACGGTATTGT

TGCAATTGGAGAACACAATGCAAACCTCTTTGAAAGATTTGTTA

Polypeptide Sequence of Variant No. 625:

(SEQ ID NO: 44)
LDNGLARTPTMGWLHWERFMCNLDCQEEPDSCISEKLFMEMAERMVTEGW

KDAGYEYLCIDDCWMAPQRDSEGRLQADPQRFPHGIRQLANHVHSKGLKL

GIYADVGNKTCAGFPGSFGYYDIDAQTFADWGVDLLKFDGCYCDSLENLA

DGYKHMSLALNRTGRPIVYSCEWPLYMWPFQKPNYTEIRQYCNHWRNFAD

IDDSWASIKSILDWTSRNQERIVDVAGPGGWNDPDMLVIGNFGLSWDQQV

TQMALWAIMAAPLFMSNDLRAISPQAKALLQDKDVIAINQDPLGKQGYQL

RKGDNFEVWERPLSGDAWAVAIINRQEIGGPRSYTIPVASLGKGVACNPA

CFITQLLPVKRQLGFYNWTSRLKSHINPTGTVLLQLENTMQTSLKDLL

Polynucleotide Sequence of Variant No. 648 yCDS:

(SEQ ID NO: 45)
TTGGATAACGGGTTAGCCCGTACACCTCCGATGGGTTGGCTTCACTGGGA

AAGATTCATGTGTAACTTAGATTGCCAAGAAGAGCCTGACAGCTGTATCT

CAGAGAAACTATTCGAAGAGATGGCTGAACGGATGGTAACCGAAGGATGG

AAGGATGCTGGTTATGAATACCTATGTATTGATGATTGCTGGATGGCTCC

ACAGCGTGATTCAGAAGGTAGGTTACAAGCTGACCCCCAGAGATTCCCAC

ATGGCATACGTCAGCTTGCAAACCATGTACACAGCAAAGGTCTAAAGTTA

GGCATCTACGCTGATGTCGGAAACAAGACATGTGCTGGTTTCCCAGGTTC

ATTCGGTTACTATGACATAGATGCGCAGACGTTTGCTGATTGGGGTGTTG

ATTTGTTGAAGTTTGATGGATGCTACTGCGATTCCCTGGAGAACCTAGCC

GATGGGTACAAACACATGAGTTTGGCTCTAAACAGGACTGGTAGGCCGAT

CGTCTATAGTTGTGAATGGCCCTTGTACATGTGGCCGTTTCAGAAGCCAA

ACTACACTGAGATAAGACAATACTGTAACCATTGGCGTAACTTTGCTGAC

ATAGATGATTCATGGGCTTCAATCAAATCTATCTTGGATTGGACTTCTCG

TAACCAGGAAAGAATTGTTGATGTTGCAGGTCCAGGTGGATGGAATGACC

CTGATATGCTTGTCATAGGGAACTTTGGGCTATCATGGGACCAACAAGTT

ACACAAATGGCTTTGTGGGCGATCATGGCCGCCCCCTATTCATGTCTAA

TGATCTACGTGCGATATCACCCCAAGCAAAGGCTTTACTTCAAGATAAGG

ATGTCATAGCGATCAACCAAGATCCTCTTGGTAAACAAGGTTATCAATTG

AGAAAAGGTGACAACTTTGAAGTGTGGGAAAGACCATTGTCTGGAGATGC

GTGGGCTGTTGCTATTATCAACCGTCAAGAGATCGGAGGGCCAAGATCTT

ACACTATCCCGGTAGCCTCTTTGGGTAAGGGTGTTGCGTGCAATCCTGCC

TGCTTCATTACACAATTGCTTCCAGTTAAGAGACAATTGGGTTTCTATAA

CGCAACCTCTAGGCTAAAAAGTCACATTAATCCTACTGGTACGGTATTGT

TGCAATTGGAGAACACAATGCAAACCTCTTTGAAAGATTTGTTA

Polypeptide Sequence of Variant No. 648:

(SEQ ID NO: 46)
LDNGLARTPPMGWLHWERFMCNLDCQEEPDSCISEKLFEEMAERMVTEGW

KDAGYEYLCIDDCWMAPQRDSEGRLQADPQRFPHGIRQLANHVHSKGLKL

-continued

```
GIYADVGNKTCAGFPGSFGYYDIDAQTFADWGVDLLKFDGCYCDSLENLA

DGYKHMSLALNRTGRPIVYSCEWPLYMWPFQKPNYTEIRQYCNHWRNFAD

IDDSWASIKSILDWTSRNQERIVDVAGPGGWNDPDMLVIGNFGLSWDQQV

TQMALWAIMAGPLFMSNDLRAISPQAKALLQDKDVIAINQDPLGKQGYQL

RKGDNFEVWERPLSGDAWAVAIINRQEIGGPRSYTIPVASLGKGVACNPA

CFITQLLPVKRQLGFYNATSRLKSHINPTGTVLLQLENTMQTSLKDLL
```

Example 1

GLA Gene Acquisition and Construction of Expression Vectors

Synthetic genes (SEQ ID NO: 1) coding for the WT human GLA sequence (SEQ ID NO: 2) and derived variants (SEQ ID NO: 4, SEQ ID NO: 6) were constructed as previously described (See e.g. US Pat. Appln. Publn. No. 2017/0360900 A1). For secreted expression and transient transfection in mammalian cells, a chimeric GLA expression construct comprising a polynucleotide encoding a synthetic mouse IG signal peptide fused to a synthetic gene coding for the different GLA variants was generated as follows. Oligonucleotides BamHI-pcDNA-GLA-F (SEQ ID NO: 63) and XhoI-pcDNA-GLA-R (SEQ ID NO: 64) were used to amplify a fragment coding for a signal peptide and the coding sequence for the mature form of GLA variants. The PCR product was ligated into the BamHI/XhoI linearized mammalian expression vector pcDNA3.1(+) (Invitrogen). Directed evolution techniques generally known by those skilled in the art were used to generate gene variants derived from SEQ ID NO: 8 within this plasmid construct (See e.g., U.S. Pat. No. 8,383,346 and WO2010/144103).

Example 2

High-Throughput Growth and Assays

High-Throughput (HTP) Growth of GLA and GLA Variants

HEK 293T cells were transfected with pcDNA 3.1(+) vectors encoding a synthetic mouse IG signal peptide fused to wild type GLA or GLA variants using the lipofection method with LIPOFECTAMINE® 3000 Reagent (ThermoFisher Scientific). HEK 293T cells were cultured in growth medium (DMEM with 10% fetal bovine serum [both from Corning]). 24 hours before transfection, cells were seeded to NUNC® Edge 2.0 96-well plate (ThermoFisher Scientific) at densities of $10^5$ cells/well/250 μL in growth medium, and incubated at 37° C., 5% $CO_2$ in an incubator. Cells were incubated for 24-72 hours at 37° C. and 5% $CO_2$, to allow for expression and secretion of GLA variants. Conditioned media (50-100 μL) from the HEK293T transfections were transferred into Corning 96-well solid black plates (Corning) for activity and/or stability analysis.

HTP-Analysis of Supernatants

GLA variant activity was determined by measuring the hydrolysis of 4-methylumbelliferyl α-D-galactopyranoside (MUGal). For an unchallenged assay, 50 μL of HEK 293T conditioned media produced as described above were mixed with 50 μL of 1 mM MUGal in McIlvaine Buffer (McIlvaine, J. Biol. Chem., 49:183-186 [1921]), pH 4.8, in a 96-well, black, opaque bottom microtiter plate. The reactions were mixed briefly and incubated at 37° C. for 30-180 minutes, prior to quenching with 100 μL of 0.5 M sodium carbonate pH 10.2. Hydrolysis was analyzed using a SPECTRAMAX® M2 microplate reader monitoring fluorescence (Ex. 355 nm, Em. 460 nm). Results from this assay are presented in Table 2-1.

HTP-Analysis of Supernatants Pretreated with Acid

GLA variants were challenged with acidic buffer to simulate the extreme pH that the variants may encounter within lysosomes. First, 50 μL of HEK 293T conditioned media and 50 uL of McIlvaine buffer (pH 3.3-4.3) were added to the wells of a 96-well round bottom microtiter plate. The plates were sealed with a PlateLoc® thermal microplate sealer (Agilent), and incubated at 37° C. for 1-2 h. For the pH 4 challenge assay, 50 μL of acid-pH-challenged sample were mixed with 50 uL of 1 mM MUGal in McIlvaine buffer pH 4.4. The reactions were mixed briefly and incubated at 37° C. for 30-180 minutes, prior to quenching with 100 μL of 0.5 M sodium carbonate, pH 10.2. Hydrolysis was analyzed using a SPECTRAMAX® M2 microplate reader monitoring fluorescence (Ex. 355 nm, Em. 460 nm). Results from this assay are presented in Table 2-1.

HTP-Analysis of Supernatants Pretreated with Base

GLA variants were challenged with basic (neutral) buffer to simulate the pHs that the variants encounter in the blood following administration to a patient. First, 50 μL of GLA variants HEK 293T conditioned media and 50 μL of McIlvaine buffer (pH 7.0-8.2) were added to the wells of a 96-well round bottom microtiter plate. The plates were sealed and incubated at 37° C. for 1-18 h. For the pH 7 challenge assay, 50 μL of basic-pH-challenged sample was mixed with 50 μL of 1 mM MUGal in McIlvaine buffer pH 4.4. The reactions were mixed briefly and incubated at 37° C. for 30-180 minutes, prior to quenching with 100 μL of 0.5 M sodium carbonate pH 10.2. Hydrolysis was analyzed using a SPECTRAMAX® M2 microplate reader monitoring fluorescence (Ex. 355 nm, Em. 460 nm). Results from this assay are presented in Table 2-1.

TABLE 2-1

Activity of GLA Variants Relative to SEQ ID NO: 8 After No Challenge (Unchallenged) or Challenge at the Indicated pH[1]

| SEQ ID NO: (nt/aa) | Amino Acid Differences (Relative to SEQ ID NO: 8) | Unchallenged FIOPC | pH 4 Challenge FIOPC | pH 7 Challenge FIOPC |
|---|---|---|---|---|
| 7/8 |  | ++ | ++ | ++ |
| 9/10 | R44L/D247N/P337A | ++ | ++++ |  |
| 11/12 | R44L/K302Q | ++ | ++++ | + |
| 13/14 | R44L/D247N/K302Q | ++ | ++++ |  |
| 15/16 | R217F/K373R | ++++ | + |  |
| 17/18 | I322M/P337A | ++++ | ++++ | ++ |
| 19/20 | R44L/D247N/K302Q/I322M | ++ | ++++ |  |
| 21/22 | K302Q/I322M/Q362K/K373R | +++ | ++++ | + |
| 23/24 | I322M | +++ | +++ | ++ |
| 25/26 | K302Q/P337A | ++ | +++ | + |
| 27/28 | R44L/R217F/I322M | +++ | +++ | ++ |
| 29/30 | R44L/D247N/I322M | ++ | +++ |  |
| 31/32 | R44L/P337A | ++ | +++ | + |
| 33/34 | R44L/K373R | ++ | +++ | + |
| 35/36 | R44L/D247N | +++ | +++ | ++ |
| 37/38 | R217F/I322M | +++ | +++ | + |
| 39/40 | R44L/R217F/D316L | ++ | +++ | + |
| 41/42 | D247N/Q362K | ++ | +++ |  |
| 43/44 | R44L/R217F | +++ | +++ | ++ |
| 45/46 | K373R | ++ | ++ | + |
| 47/48 | D247N/I322M | ++ | ++ |  |
| 49/50 | R44L | ++ | ++ | + |

TABLE 2-1-continued

Activity of GLA Variants Relative to SEQ ID NO: 8 After No Challenge (Unchallenged) or Challenge at the Indicated pH[1]

| SEQ ID NO: (nt/aa) | Amino Acid Differences (Relative to SEQ ID NO: 8) | Unchallenged FIOPC | pH 4 Challenge FIOPC | pH 7 Challenge FIOPC |
|---|---|---|---|---|
| 51/52 | D316L | ++ | ++ | + |
| 53/54 | R44L/D247N/Q362K | ++ | ++ | |
| 55/56 | D316L/P337A | ++ | ++ | |
| 57/58 | Q362K/K373R | ++ | + | |
| 59/60 | R44L/R217F/I322M/ P337A | + | | |

[1]Levels of increased activity were determined relative to the reference polypeptide of SEQ ID NO: 8, and defined as follows: "+" > 0.75; "++" > 0.9; "+++" > 1.1; and "++++" > 1.2.

Example 3

Production of GLA Variants

Production of GLA in HEK293T Cells

Secreted expression of GLA variants in mammalian cells was performed by transient transfection of HEK293 or HEK293T cells. Cells were transfected with GLA variants (SEQ ID NOS: 3, 4, 9, 12, 17, 20, 23, and 41) fused to an N-terminal synthetic mammalian signal peptide and subcloned into the mammalian expression vector pLEV113, as described in Example 1. HEK293 cells were transfected with plasmid DNA and grown in suspension for 4 days using standard techniques known to those skilled in the art. Supernatants were collected and stored at 4° C. until analyzed.

Example 4

Purification of GLA Variants

Purification of GLA Variants from Mammalian Cell Supernatants

WT GLA (SEQ ID NO: 2) was purified from mammalian culture supernatant as described in the literature (Yasuda et al., Prot. Exp. Pur., 37:499-506 [2004]). All other GLA variants were purified as follows. GLA variants were purified from mammalian culture supernatant essentially as known in the art (See, Yasuda et al., Prot. Exp. Pur., 37:499-506 [2004]). Concanavalin A resin (Sigma Aldrich) was equilibrated with 0.1 M sodium acetate, 0.1 M NaCl, 1 mM $MgCl_2$, $CaCl_2$, and $MnCl_2$, pH 6.0 (Concanavalin A binding buffer). Supernatant was sterile-filtered with 0.2 μm bottle-top filter before it was loaded onto the column. After loading, the column was washed with 10 column volumes of Concanavalin A binding buffer and the bound protein was eluted with Concanavalin A binding buffer supplemented with 0.9 M methyl-α-D-mannopyranoside and 0.9 M methyl-α-D-glucopyranoside. Eluted protein was concentrated and the buffer exchanged into storage buffer (20 mM sodium phosphate, 150 mM sodium chloride, 185 μM TWEEN®-20 non-ionic detergent, pH 6.0) using an Amicon® Ultra 15 mL filtration unit with a 30 kDa molecular weight cut off (Millipore) membrane. The GLA in storage buffer was sterile filtered through ANOTOP® 0.2 μm syringe filters (Whatman), and stored at −80° C. Purification provided 2.4-50 μg of purified protein/ml of culture supernatant based on BCA quantitation.

Protein Quantification by the BCA Protein Assay

A bicinchoninic acid (BCA) protein assay (Sigma Aldrich) was used to quantify purified GLA. In microtiter plate, 25 uL of protein standards and purified GLA with proper dilution were mixed with 200 uL of working reagent containing 50 parts of BCA reagent A and 1 part of BCA reagent B. The plate was thoroughly mixed on a plate shaker for 30 seconds and incubated at 37° C. for 30 minutes. After the plates cooled down to room temperature, absorbance of the samples was measured at 562 nm using a plate reader.

Example 5

In Vitro Characterization of GLA Variants

Thermostability of GLA Variants Expressed in HEK 293T Cells

GLA variants were exposed to various temperature challenges to assess the overall stability of the enzyme. First, 50 μL of purified HEK 293T expressed GLA and GLA variants in 1×PBS pH 6.2 were added to the wells of a 96-well PCR plate (Biorad, HSP-9601). The plates were sealed and incubated at 30-50° C. for 1 h using the gradient program of a thermocycler. For the assay, 25 μL of challenged supernatant was mixed with 25 μL of 1 mM MUGal in McIlvaine buffer pH 4.4. The reactions were mixed briefly and incubated at 37° C. for 60 minutes, prior to quenching with 100 μL of 0.5 M sodium carbonate, pH 10.2. Hydrolysis was analyzed using a SPECTRAMAX® M2 microplate reader monitoring fluorescence (Ex. 355 nm, Em. 460 nm). The percent residual activity was calculated for 1 h incubations at temperatures ranging from 30° C. to 50° C., by dividing the activity of challenged samples by the activity of unchallenged samples, in which "unchallenged" is the hydrolysis measured at time 0, and "challenged" is hydrolysis measured at 1 hour at the specified temperature for each variant. Results from this assay are shown in Table 5-1. FIG. 1 provides a graph showing the residual activity of GLA variants after 1 hr incubation at various temperatures.

Serum Stability of GLA Variants Expressed in HEK 293T Cells

Figure 2:
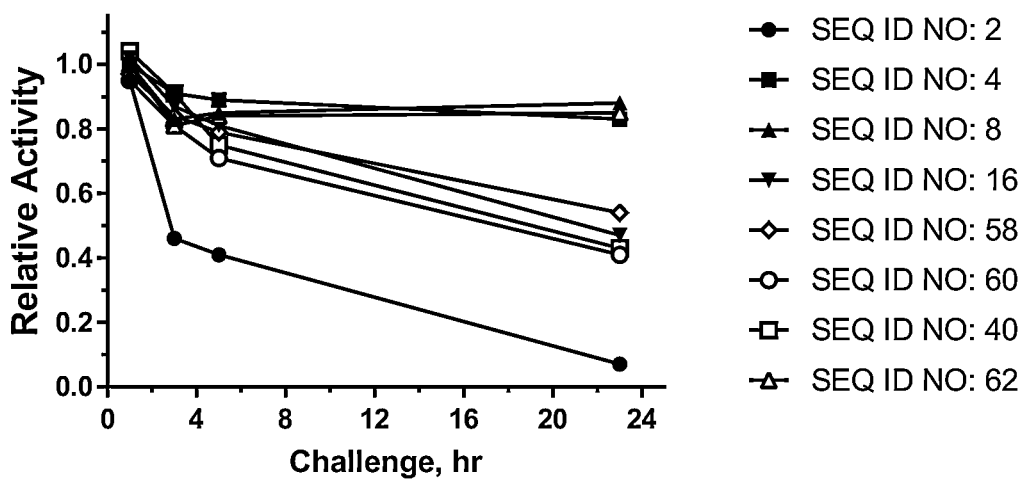
FIG. 2 provides a graph showing the relative activity of GLA variants after challenge at 37° C. for 0-24 hours with human serum.

To assess the relative stability of variants in the presence of blood, samples were exposed to serum. First, 100 μL of 7.5 ug/mL purified GLA variants in 1×PBS pH 6.2 and 90 uL of human serum were added to the wells of a COSTAR® 96-well round bottom plate (Corning). The plates were sealed and incubated at 37° C. for 0-24h. For the assay, 50 μL of challenged supernatant were mixed with 50 μL of 1 mM MUGal in McIlvaine buffer pH 4.4. The reactions were mixed briefly and incubated at 37° C. for 90 minutes, prior to quenching with 100 μL of 0.5 M sodium carbonate, pH 10.2. Hydrolysis was analyzed using a SPECTRAMAX® M2 microplate reader monitoring fluorescence (Ex. 355 nm, Em. 460 nm). Percent residual activity in serum after 24h was calculated by dividing the activity of challenged samples by the activity of unchallenged samples, in which "unchallenged" is hydrolysis measured at time 0 and "challenged" is hydrolysis measured at the specified time points for each variant. The results are shown in Table 5.1. FIG. 2 provides a graph showing the residual activity of GLA variants after a challenge with human serum for 0-24 hrs.

Lysosomal Stability of GLA Variants Expressed in HEK 293T Cells

To assess the relative stability of variants in the presence of lysosomal proteases and other lysosomal components, GLA variants were exposed to human lysosomal lysate (XenoTech, #H0610.L) following the manufacturer's instructions with some modifications, as described herein.

Figure 3:
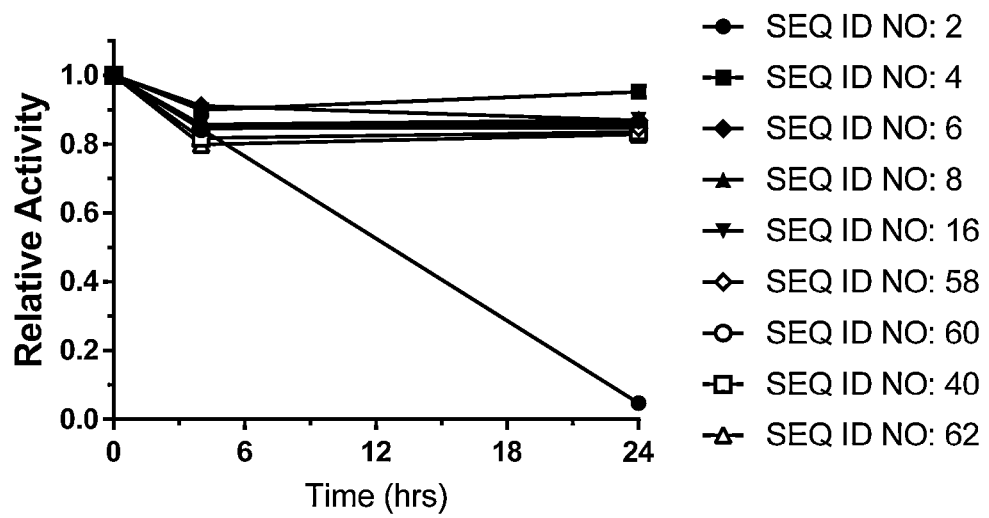
FIG. 3 provides a graph showing the relative activity of GLA variants after challenge at 37° C. for 0-24 hours with human lysosomal extract.

Briefly, GLA variants were diluted to an appropriate concentration range (0.0625-0.0078125 mM) and 10 µL of the dilutions were combined with 10 µL of a 1:20 dilution of human lysosomal lysate in 2× catabolic buffer (XenoTech, #K5200) in a COSTAR® 96-well round bottom plate (#3798, Corning). The plates were sealed and incubated at 37° C. for 0-24h. For the assay, 50 µL of challenged supernatant was mixed with 50 µL of 1 mM MUGal in McIlvaine buffer pH 4.4. The reactions were mixed briefly and incubated at 37° C. for 90 minutes, prior to quenching with 100 µL of 0.5 M sodium carbonate pH 10.2. Hydrolysis was analyzed using a SPECTRAMAX® M2 microplate reader monitoring fluorescence (Ex. 355 nm, Em. 460 nm). Percent residual activity in lysosomal extract after 24h was calculated by dividing the activity of challenged samples by the activity of unchallenged samples, in which "unchallenged" is hydrolysis measured at time 0 and "challenged" is hydrolysis measured at 4 and 24 hours for each variant. The results are provided in Table 5.1. FIG. 3 provides a graph showing the residual activity of GLA variants after challenge with human lysosomal extract for 0 to 24 hrs.

Figure 4:
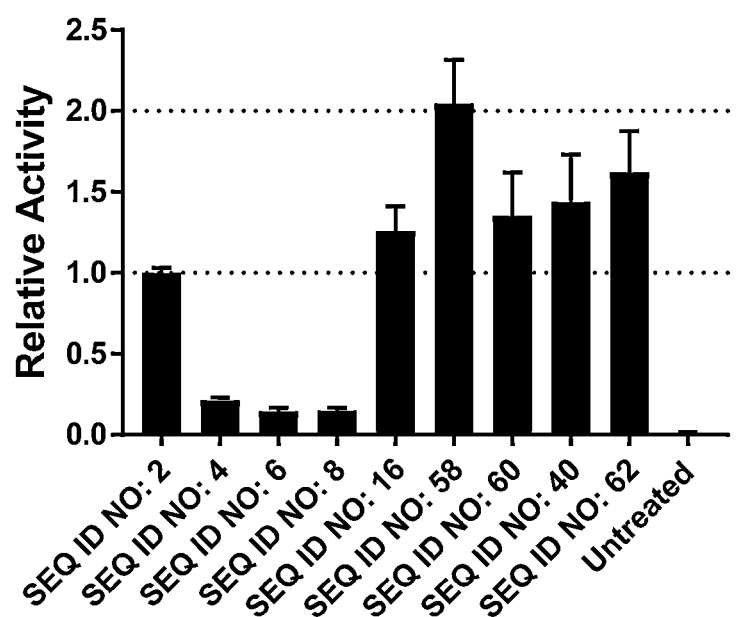
FIG. 4 provides a graph showing the cellular uptake of different purified GLA variants, expressed as relative activity compared to wild type after 4 hours incubation at 37° C. with cultured Fabry patient fibroblasts.

Cellular Uptake in Fabry Fibroblasts of Purified GLA Variants Expressed in HEK293T Cells Cellular uptake of GLA variants as compared to a reference enzyme (WT GLA [SEQ ID NO: 2]), was determined to assess the overall ability of the variants to be endocytosed into cultured cells. Fabry fibroblasts (GM02775, Coriell Institute for Medical Research) were seeded into a 12-well culture dish (VWR, #10861-698) containing Minimal Essential Media (MEM; Gibco #11095-080, supplemented with 1% non-essential amino acids (NEAA; Gibco #11140-050) and 15% fetal bovine serum (Corning #35-016-CV)) and allowed to grow to confluency (2-3 days at 37° C., 5% $CO_2$). After reaching confluency, supplemented MEM was removed by sterile vacuum and replaced with 1 mL/well serum-free MEM+1% NEAA. Enzymes purified as described in Example 4, were added to cells at 10 ug GLA/mL and allowed to incubate for 4 hours at 37° C., 5% $CO_2$. Serum-free media was aspirated by sterile vacuum, the cells briefly washed with 1 mL 1×PBS/well, and PBS aspirated by sterile vacuum. Cells were then trypsinized with 200 µL/well 0.25% trypsin-EDTA (VWR #02-0154-0100) and incubated for ~5 minutes at room temperature to dislodge adherent cells from the plate and degrade remaining extracellular GLA. Then, 500 µL serum-free MEM was added to each well, and the samples transferred to 1.5 mL microcentrifuge tubes. Samples were centrifuged at 8000 RPM for 5 min. to pellet the cells. Media was gently aspirated with a 1000 µL pipette. The cell pellets were resuspended in 500 µL 1×PBS, re-pelleted at 8000 RPM for 5 min, and the PBS was gently removed. Then, 100 µL Lysis Buffer (0.2% TRITON X100™ non-ionic surfactant (Sigma #93443) diluted in 1×PBS) was added to each sample, followed by sonication for 1-2 minutes, and centrifugation at 12,000-14,000 RPM for 10 minutes at 4° C. Supernatant was transferred to a sterile PCR tube for protein and activity assay. For the activity assay, 10 µL of cell lysis sample was mixed with 50 µL of 2.5 mM MUGal in McIlvaine buffer, pH 4.6. The reaction plates were sealed and incubated at 37° C. for 60 minutes, prior to reaction quenching with 140 µL of 0.5 M sodium carbonate pH 10.2 per well. MUGal hydrolysis was determined using a SPECTRAMAX® M2 microplate reader monitoring fluorescence (Ex. 355 nm, Em. 460 nm). For the protein quantification, the BCA assay was carried out following the manufacturer's instructions (Pierce, #23225) with the following modifications: 10 µL of cell lysis sample were mixed with 190 µL BCA Working Reagent, and the plates sealed and incubated at 37° C. for 60 minutes. Samples were analyzed using a SPECTRAMAX® M2 microplate reader monitoring absorbance (562 nm). The protein concentrations were calculated from a BSA standard curve. Cellular uptake of each GLA variant was calculated by first subtracting background non-enzymatic fluorescence of the untreated cells from enzyme-treated samples, and then normalizing to the protein concentration in each well. Cellular uptake FIOPC was calculated by dividing the normalized GLA variant intracellular activity by the corresponding activity of the control (WT). FIG. 4 provides a graph of the cellular uptake of purified GLA variants in cultured Fabry patient fibroblasts, expressed as relative activity compared to wild type (SEQ ID NO: 2), after 4 hours incubation at 37° C.

TABLE 5-1

Relative Activity and Cellular Uptake of GLA Variants Produced in HEK293T Cells[1]

| SEQ ID NO: (nt/aa) | Amino Acid Differences (Relative to SEQ ID NO: 8) | Lysosomal Stability % Residual Activity at 24 h | % Residual Activity at 37° C. (1 h) | % Residual Activity at 50° C. (1 h) | Serum Stability % Residual Activity at 24 h |
|---|---|---|---|---|---|
| 1/2 | P10T/E39M/R44L/ T47S/H92Y/P166S/ A206K/R217F/ D247N/G261A/ A271H/K302Q/ D316L/I322M/ P337A/Q362K/ A368W/K373R/ T392M | | + | + | |
| 7/8 | | +++ | ++++ | +++ | +++ |
| 15/16 | R217F/K373R | +++ | ++++ | ++++ | |
| 57/58 | Q362K/K373R | +++ | ++++ | ++++ | + |
| 59/60 | R44L/R217F/ I322M/3P37A | +++ | ++++ | ++++ | |
| 39/40 | R44L/R217F/ D316L | +++ | ++++ | ++++ | |
| 61/62 | P166A/Q362K | +++ | ++++ | ++++ | +++ |

[1]The percent (%) residual activity at 35° C. and 50° C., as well as lysosomal and serum stability percent (%) residual activity, were determined relative to each individual variant and defined as follows: "+" > 50%; "++" >60%; "+++" > 80%; and "++++" >95%. The residual activity for each variant at 1 hour was determined, relative to its activity at time 0.

HTP-Analysis of GLA Activity in Lysates of Fabry Fibroblasts

GLA variants produced in HTP were challenged to be taken up into cells and retain activity over 24 to 96 hours. Fabry fibroblasts (GM02775, Coriell Institute for Medical Research) were plated and allowed to grow to confluency over 24-72 hours. After reaching confluency, media was removed using an automated BioMek i5 liquid handling robot. Conditioned media from HEK293T cells transiently transfected as described above, were added to the Fabry fibroblasts and the cells allowed to incubate with the GLA variants for 2-4 hours at 37° C., 5% $CO_2$. GLA-containing conditioned media were removed with an automated BioMek i5 liquid handling robot. Then, the cells were briefly washed with 150 µL 1×DPBS/well, and the DPBS was removed with an automated BioMek i5 liquid handling robot. Then, 200 µL of the complete growth medium were added to each well, and the plates were returned to the incubator for 24-72 hours. At the conclusion of incubation, complete growth media was removed with an automated BioMek i5 liquid handling robot. The cells were washed with 150 µL 1×DPBS/well, and the DPBS was removed with an automated BioMek i5 liquid handling robot. The cells were lysed via addition of 50 µL of McIlvaine buffer, pH 4.4, supplemented with 0.2% TRITON X-100™ non-ionic surfactant (Sigma #93443)) and agitation at room temperature for 30 minutes. Activity was assessed by addition of 50 μL of 1.5 mM MuGal in McIlvaine buffer, pH 4.4. The plates were sealed and incubated at 37° C. for 360 minutes with agitation at 400 rpm, prior to quenching with 100 μL of 0.5 M sodium carbonate, pH 10.2. Hydrolysis was analyzed using a SPECTRAMAX® M2 microplate reader monitoring fluorescence (Ex. 355 nm, Em. 460 nm). Cellular uptake FIOPC was calculated by dividing normalized GLA variant intracellular activity by the corresponding activity of the reference sequence.

HTP-Analysis of GLA Induced Depletion of Globotriaosylceramide in Fabry Fibroblasts GLA variants produced in HTP were challenged to be taken up into cells and reduce the cellular load of globotriaosylceramide. Fabry fibroblasts (GM02775, Coriell Institute for Medical Research) were plated and allowed to grow to confluency over 24-72 hours. After reaching confluency, media were removed by automated an BioMek i5 liquid handling robot. Conditioned media produced by HEK293T cells transiently transfected as described above, were added to the fibroblast cells and allowed to incubate for 2-4 hours at 37° C., 5% $CO_2$. GLA-containing conditioned media were removed with an automated BioMek i5 liquid handling robot. Then, the cells were briefly washed with 150 μL 1×DPBS/well, and the DPBS was removed with an automated BioMek i5 liquid handling robot. Then, 200 μL of the complete growth medium was added to each well, and the plates were returned to the incubator for 24-72 hours. At the conclusion of incubation, the complete growth media was removed with an automated BioMek i5 liquid handling robot. Then, the cells were washed with 150 μL 1×DPBS/well, and the DPBS was removed with an automated BioMek i5 liquid handling robot. Globotriaosylceramide was extracted into 200 uL methanol supplemented with 10 ng/mL N-heptadecanoyl-ceramide trihexoside for 30 minutes at room temperature with gentle agitation. Methanol extractions were filtered through a Millipore hydrophobic filter stack into round bottom 96-well plates. Cellular globotriaosylceramide was quantified essentially as known in the art (See, Provencal et al., Bioanal., 8:1793-1807 [2016]) by LC-MS/MS. The sum of peak integrations for each cell sample was determined and globotriaosylceramide FIOPC was calculated by dividing the change in normalized GLA variant globotriaosylceramide levels by the reference sequence.

Example 6

GLA Variants Derived from SEQ ID NO: 58

In this Example, experiments conducted to assess activity of and Gb3 clearance by GLA variants in Fabry fibroblasts are described. In this Example, SEQ ID NO: 58 was used as the reference sequence (i.e., the amino acid differences in the variants are indicated relative to SEQ ID NO: 58, and the assay results are reported relative to the results obtained for SEQ ID NO: 58). In these experiments, the GLA variants were tested for MU-Gal activity without pre-incubation, as described in Example 5. Variants were also tested for Gb3 depletion in Fabry fibroblasts as described in Example 5.

TABLE 6-1

Relative Performance of GLA Variants in Unchallenged Conditions and in Depletion of Gb3 in Fabry Fibroblast Cells (Relative to SEQ ID NO: 58)[1]

| SEQ ID NO: (nt/aa) | Amino Acid Differences (Relative to SEQ ID NO: 58) | Unchallenged FIOPC | Gb3 Depletion in Fabry Fibroblast Cells |
|---|---|---|---|
| 67/68 | R7L/Y120H | + | + |
| 69/70 | R7L/F365V | + | |
| 71/72 | R7L/Q88A/Y120H/N305G/F365V | ++ | |
| 73/74 | R7L/N305G | ++ | + |
| 75/76 | Q88A | ++ | |
| 77/78 | D282N | ++ | + |
| 79/80 | Q299R/L300I | ++ | |
| 81/82 | Y120H | ++ | |
| 83/84 | R7L | +++ | + |
| 85/86 | R7L/N305G/F365V | +++ | |
| 87/88 | Y120H/Q299R/N305G | +++ | |
| 89/90 | R7L/E48D/Q68E/Y120H/D282N/Q299R | +++ | ++ |
| 91/92 | E48D | +++ | ++ |
| 93/94 | Q68E | +++ | ++ |
| 95/96 | R7L/D130E | +++ | ++ |
| 97/98 | P67T/F180G | +++ | |
| 99/100 | R7L/E48D/F180G | +++ | |
| 101/102 | F365V | +++ | |
| 103/104 | L300I | +++ | ++ |
| 105/106 | R7L/E48D/Q68E | +++ | ++ |
| 107/108 | E48D/F180G/D282N | +++ | |
| 109/110 | F180G | +++ | |
| 111/112 | Q299R/L300I/N305G/F365V | +++ | |
| 113/114 | D282N/F365V | ++++ | |
| 115/116 | E48D/D282N/N305G | ++++ | + |
| 117/118 | R7L/Q68E/F180G | ++++ | |
| 119/120 | N305G | ++++ | ++ |
| 121/122 | Q68E/Q299R/L300I | ++++ | ++ |
| 123/124 | R7L/E48D/D130E/D282N | ++++ | ++ |
| 125/126 | E48D/Q68E | ++++ | +++ |
| 127/128 | N305G/F365V | ++++ | |
| 129/130 | R7L/D282N | ++++ | + |
| 131/132 | R7L/Q68E/D130E/D282N/F365V | ++++ | ++ |
| 133/134 | E48D/D282N | ++++ | ++ |
| 135/136 | A206S | ++ | |
| 137/138 | K343D | | +++ |
| 139/140 | K343G | ++ | ++ |
| 141/142 | K96L | ++ | +++ |
| 143/144 | K96L/P312Q/K343G | ++ | |
| 145/146 | K96L/S273P | + | +++ |
| 147/148 | L158A/R162K/S273G | | ++ |
| 149/150 | L158R | + | |
| 151/152 | N91Q/S95E | | +++ |
| 153/154 | N91Q/S95E/K96L | | +++ |
| 155/156 | R162H/K343D | + | |
| 157/158 | R162K | ++ | +++ |
| 159/160 | R162K/S273P | + | +++ |
| 161/162 | R162S | ++ | +++ |
| 163/164 | R87K/K96I/H155N/S273P/K343G | | ++ |
| 165/166 | R87K/N91Q/S95E/K96L/A206S/K343G | + | |
| 167/168 | R87K/N91Q/S95E/K96L/L158A/R162K | | +++ |
| 169/170 | S273P | | +++ |
| 171/172 | S273P/K343G | ++ | |
| 173/174 | T47D | ++ | ++ |
| 175/176 | T47D/K343G | + | ++ |
| 177/178 | T47D/R87K/S95E/K96L/L158R/R162H | | ++ |
| 179/180 | T47D/S273P | ++ | +++ |
| 181/182 | T47D/S95E | | +++ |
| 183/184 | W178G | + | |
| 185/186 | T389K | + | |
| 187/188 | F180T | +++ | |
| 189/190 | F365A | ++++ | |
| 191/192 | F180V | ++++ | |
| 193/194 | L158A | + | |
| 195/196 | F180L | + | |

TABLE 6-1-continued

Relative Performance of GLA Variants in Unchallenged Conditions and in Depletion of Gb3 in Fabry Fibroblast Cells (Relative to SEQ ID NO: 58)[1]

| SEQ ID NO: (nt/aa) | Amino Acid Differences (Relative to SEQ ID NO: 58) | Unchallenged FIOPC | Gb3 Depletion in Fabry Fibroblast Cells |
|---|---|---|---|
| 197/198 | S370G | ++ | |
| 199/200 | L398S | +++ | |
| 201/202 | L397A | ++ | |
| 203/204 | A206K | ++++ | |
| 205/206 | P166K | +++ | |
| 207/208 | A271R | + | |
| 209/210 | D396G/L398T | ++ | |
| 211/212 | W178S | + | + |
| 213/214 | S314A | + | + |
| 215/216 | S71P | ++ | + |
| 217/218 | L394K | | + |
| 219/220 | Q181A | + | + |
| 221/222 | V345A | ++ | + |
| 223/224 | V93I | | + |
| 225/226 | F365Q | ++ | + |
| 227/228 | I336V | ++ | + |
| 229/230 | H92F | + | + |
| 231/232 | L398V | +++ | + |
| 233/234 | L398P | +++ | ++ |
| 235/236 | R301M | ++++ | ++ |
| 237/238 | P337R | ++ | ++ |
| 239/240 | S333G | +++ | ++ |
| 241/242 | L363Q | ++++ | ++ |
| 243/244 | T47V | | ++ |
| 245/246 | H92T | ++++ | ++ |
| 247/248 | S393V | + | ++ |
| 249/250 | D151L | | ++ |
| 251/252 | S333F | ++++ | ++ |
| 253/254 | L293P/Q391A | ++ | ++ |
| 255/256 | V345Q | + | ++ |
| 257/258 | E39V | | ++ |
| 259/260 | R217K | ++ | ++ |
| 261/262 | L398A | | +++ |

[1]All activities were determined relative to the reference polypeptide of SEQ ID NO: 58. Levels of increased activity are defined as follows: "+" = 0.9 to 1.1; "++" > 1.1; "+++" > 1.5; and "++++" > 2.

Example 7

GLA Variants Derived from SEQ ID NO: 158

In this Example, experiments conducted to assess the activity, stability at pH 7.4, and intracellular activity in Fabry fibroblasts of GLA variants are described. In this Example, the reference sequence was SEQ ID NO: 158 (i.e., the amino acid differences in the variants are indicated relative to SEQ ID NO: 158, and the assay results are reported relative to the results for SEQ ID NO: 158). The variants were tested for GLA MU-Gal activity without pre-incubation (unchallenged) and after pH 7.4 pre-incubation as described in Example 5. Variants were also tested for MU-Gal activity after lysis of Fabry fibroblasts incubated with GLA variants as described in Example 5.

TABLE 7-1

Relative performance of GLA Variants (Relative to SEQ ID NO: 158)

| SEQ ID NO: (nt/aa) | Amino Acid Differences (Relative to SEQ ID NO: 158) | Unchallenged FIOPC | Lysate FIOPC | Stability after pH 7.4 Preincubation FIOPC |
|---|---|---|---|---|
| 263/264 | E48D | ++ | + | ++++ |
| 265/266 | E48D/Q68E | + | | ++++ |
| 267/268 | E48D/Q68E/R217K/ S333F/Q391A/S393V | + | | ++++ |
| 269/270 | E48D/Q68E/S333F | + | | ++++ |
| 271/272 | E48D/R217K | + | + | ++++ |
| 273/274 | E48D/S333F | | | ++++ |
| 275/276 | E48D/S333G | + | + | ++++ |
| 277/278 | E48D/S393V | + | + | +++ |
| 279/280 | E48D/V345Q/S393V | | | +++ |
| 281/282 | Q68E | + | | +++ |
| 283/284 | Q68E/V345Q | ++ | ++ | ++++ |
| 285/286 | R217K/S333F | + | + | +++ |
| 287/288 | R217K/S333G | + | + | ++++ |
| 289/290 | S333F/V345Q | + | ++ | ++ |
| 291/292 | S333G | ++ | ++ | ++++ |
| 293/294 | D130E | | + | |
| 295/296 | D151L/A206S/D282N/ P337R/K343D/V345Q/ L398A | ++ | + | |
| 297/298 | D130E/V345Q/S393V | | + | |
| 299/300 | E39V/P337R/K343G/ L398A | + | | |
| 301/302 | T47V/D151L | + | + | |
| 303/304 | T47 V/D130E | + | + | |
| 305/306 | T47V/K343D/V345Q/ S393V | + | + | |
| 307/308 | A206S/R217K | + | | |
| 309/310 | P337R/K343G/V345Q/ L398A | + | | |
| 311/312 | D282N/S393V | + | | |
| 313/314 | K343D | + | + | |
| 315/316 | K343D/V345Q/S393V/ L398A | + | | |
| 317/318 | E39V/T47V/R217K | + | | |
| 319/320 | A206S | + | | |
| 321/322 | S393V/L398A | + | | |
| 323/324 | E39V/D282N/P337R/ L398A | + | + | |
| 325/326 | D151L | + | | |
| 327/328 | S393V | + | + | |
| 329/330 | R217K/P337R/V345Q/ L398A | + | + | |
| 331/332 | D151L/D282N/S393V | + | | + |
| 333/334 | E39V/S393V/L398A | + | | + |
| 335/336 | L158R | | | + |
| 337/338 | D151L/L158R/R217K/ K343G/V345Q/S393V | + | ++ | + |
| 339/340 | D130E/L158R | | + | + |
| 341/342 | D151L/S393V | | + | + |
| 343/344 | R217K | + | + | + |
| 345/346 | D130E/L158R/S393V | | ++ | +++ |
| 347/348 | E39V/D151L | + | | +++ |
| 349/350 | D151L/V345Q/S393V/ L398A | + | ++ | +++ |
| 351/352 | E39V/T47D | ++ | + | ++++ |
| 353/354 | L158R/S393V | ++ | + | ++++ |
| 355/356 | C59A/C143S | | | + |
| 357/358 | A271N | | ++ | |
| 359/360 | D202N | | | ++++ |
| 361/362 | D24S/D202N | + | | |
| 363/364 | S333N | + | | |
| 365/366 | C143S/S333N | + | | |
| 367/368 | C143S/A271N | ++ | | +++ |
| 369/370 | C143S/E387N | ++ | | ++ |

[1]All activities were determined relative to the reference polypeptide of SEQ ID NO 158. Levels of increased activity are defined as follows: "+" = 0.9 to 1.1; "++" > 1.1; "+++" > 1.5; and "++++" > 2.5.

Example 8

GLA Variants Derived from SEQ ID NO: 372

In this Example, experiments conducted to assess the activity, stability at pH 7.4, Gb3 clearance, and intracellular activity in Fabry fibroblasts of GLA variants are described. In this Example, the reference sequence was SEQ ID NO: 372 (i.e., the amino acid differences in the variants are indicated relative to SEQ ID NO: 372, and the assay results are reported relative to the results for SEQ ID NO: 372). These variants were tested for MU-Gal activity without pre-incubation ("unchallenged") and after pH 7.4 pre-incubation as described in Example 5. Variants were also tested for MU-Gal activity in Fabry fibroblasts incubated with GLA variants as described in Example 5 ("Lysate FIOPC"). Variants were also tested for depletion of Gb3 in Fabry fibroblasts after incubation with GLA variants as described in Example 5 ("Gb3 FIOPC").

TABLE 8-1

Relative performance of GLA Variants (Relative to SEQ ID NO: 372)

| SEQ ID NO: (nt/aa) | Amino Acid Differences (Relative to SEQ ID NO: 372) | Unchallenged FIOPC | Stability After pH 7.4 Preincubation FIOPC | Lysate FIOPC | Gb3 FIOPC |
|---|---|---|---|---|---|
| 375/376 | F217R/N247D/L316D/M322I/A337P/W368A | + | ++++ | | |
| 377/378 | H271A | + | | | + |
| 379/380 | H271A/L316D/M322I | +++ | ++ | | |
| 381/382 | H271A/Q302K/M322I | +++ | ++++ | ++ | |
| 383/384 | K206A/F217R/H271A/M392T | ++ | ++++ | +++ | + |
| 385/386 | L44R/K206A/A337P | +++ | +++ | ++++ | ++ |
| 387/388 | L44R/N247D/A261G/Q302K/L316D | ++ | | ++ | |
| 389/390 | L44R/N247D/A261G/Q302K/L316D/M322I | ++ | + | + | |
| 391/392 | L44R/S47T/K206A/F217R/N247D/H271A/M322I | + | ++++ | ++++ | |
| 393/394 | L44R/S47T/N247D/M322I/W368A | +++ | ++++ | ++ | |
| 395/396 | L44R/S47T/Q302K/L316D/M322I | +++ | ++++ | +++ | |
| 397/398 | L44R/S47T/Y92H/K206A/F217R/L316D/M322I | ++++ | ++++ | ++++ | |
| 399/400 | L44R/S47T/Y92H/N247D/A261G/H271A/L316D/A337P/W368A | ++ | + | + | |
| 401/402 | L44R/Y92H/K206A/N247D/W368A | ++ | + | +++ | ++ |
| 403/404 | L89I/F217R/N247D/A261G/Q302K/L316D | ++ | + | | |
| 405/406 | M39E/L44R/Y92H/F217R/M322I | +++ | + | +++ | |
| 407/408 | M39E/L44R/Y92H/N247D/H271A/Q302K | ++ | | ++ | + |
| 409/410 | M39E/L44R/Y92H/R162M/N247D/Q302K/L316D/M322I | ++ | + | ++ | |
| 411/412 | M39E/M322I | +++ | + | ++ | |
| 413/414 | M39E/N247D/H271A | + | + | + | + |
| 415/416 | M39E/N247D/H271A/L316D | +++ | +++ | | |
| 417/418 | M39E/S47T/F217R/N247D/W368A | ++++ | ++++ | | |
| 419/420 | M39E/S47T/N247D | +++ | + | + | |
| 421/422 | M39E/S47T/Y92H/N247D/Q302K/L316D/M322I | + | +++ | + | |
| 423/424 | M39E/Y92H/L316D/M322I | + | + | ++ | + |
| 425/426 | M39E/Y92H/N247D/Q302K/L316D/A337P/W368A | ++++ | ++++ | + | |
| 427/428 | N247D | + | ++++ | + | |
| 433/434 | N247D/H271A | +++ | ++ | + | |
| 435/436 | N247D/Q302K | ++ | ++++ | ++ | + |
| 437/438 | Q302K/M322I/W368A | ++ | + | + | |
| 439/440 | S47T/F217R/Q302K | +++ | +++ | +++ | |
| 441/442 | S47T/N247D | ++ | ++++ | + | |
| 443/444 | S47T/N247D/H271A | +++ | ++++ | ++ | |
| 445/446 | S47T/Y92H/N247D/H271A | ++ | ++ | + | + |
| 447/448 | T10P | ++ | ++ | ++ | ++ |
| 449/450 | T10P/A261G | + | + | ++ | |
| 451/452 | T10P/A337P/M392T | ++ | ++ | + | ++ |
| 453/454 | T10P/H271A/Q302K | +++ | ++++ | ++ | + |
| 455/456 | T10P/K206A/A261G/H271A/L316D | + | + | ++ | |
| 457/458 | T10P/K206A/F217R/H271A | ++ | ++++ | ++++ | |
| 459/460 | T10P/K206A/N247D | ++++ | ++++ | ++++ | |
| 461/462 | T10P/L316D/M322I | +++ | ++++ | ++ | + |
| 463/464 | T10P/L44R | +++ | + | +++ | ++ |
| 465/466 | T10P/L44R/A261G/Q302K/L316D | ++ | | ++ | + |
| 467/468 | T10P/L44R/Q302K/A337P/W368A | ++++ | ++++ | ++++ | |
| 469/470 | T10P/L44R/S47T/A261G/Q302K/M322I/W368A | +++ | + | +++ | |
| 471/472 | T10P/L44R/S47T/Y92H/N247D | + | +++ | +++ | |
| 473/474 | T10P/L44R/Y92H/L316D/M322I | ++++ | +++ | +++ | |

TABLE 8-1-continued

Relative performance of GLA Variants
(Relative to SEQ ID NO: 372)

| SEQ ID NO: (nt/aa) | Amino Acid Differences (Relative to SEQ ID NO: 372) | Unchallenged FIOPC | Stability After pH 7.4 Preincubation FIOPC | Lysate FIOPC | Gb3 FIOPC |
|---|---|---|---|---|---|
| 475/476 | T10P/M39E/L44R/M322I | +++ | | +++ | + |
| 477/478 | T10P/M39E/Y92H/K206A/F217R/H271A | ++ | +++ | +++ | |
| 479/480 | T10P/M39E/Y92H/N247D | +++ | +++ | + | |
| 481/482 | T10P/M39E/Y92H/N247D/H271A/L316D | + | +++ | | |
| 483/484 | T10P/Q302K | ++ | + | +++ | +++ |
| 485/486 | T10P/Q302K/L316D | ++ | +++ | ++ | + |
| 487/488 | T10P/Q302K/M322I/A337P | +++ | ++++ | +++ | ++ |
| 489/490 | T10P/S47T/F217R/M322I | + | +++ | ++ | + |
| 491/492 | T10P/S47T/F217R/N247D/L316D/M392T | +++ | ++++ | + | |
| 493/494 | T10P/S47T/H271A | +++ | ++ | ++ | |
| 495/496 | T10P/W368A | +++ | ++ | + | |
| 497/498 | T10P/Y92H | + | + | ++ | |
| 499/500 | T10P/Y92H/F217R/A261G/Q302K/A337P | ++ | + | ++ | |
| 501/502 | T10P/Y92H/K206A/F217R/N247D | + | ++++ | +++ | + |
| 503/504 | T10P/Y92H/K206A/N247D/L316D/M322I/M392T | + | ++++ | ++ | |

[1]All activities were determined relative to the reference polypeptide of SEQ ID NO 372. Levels of increased activity are defined as follows: "+" = 0.9 to 1.1; "++" > 1.1; "+++" > 1.5; and "++++" > 2.

Example 9

GLA Variants Derived from SEQ ID NO: 374

In this Example, experiments conducted to determine GLA variant activity by assaying the enzyme activity after a series or independent challenges are described. These variants were tested for GLA MU-Gal activity after no pre-incubation and after pH 7.4 pre-incubation, as described in Example 5. Variants were also tested for MU-Gal activity after lysis of Fabry fibroblasts incubated with variants as described in Example 5. Variants were also tested for Gb3 depletion in Fabry fibroblasts after incubation, as described in Example 5.

TABLE 9-1

Relative Performance of GLA Variants
(Relative to SEQ ID NO: 374)[1]

| SEQ ID NO: (nt/aa) | Amino Acid Differences (Relative to SEQ ID NO: 374) | Unchallenged FIOPC | Stability FIOPC | Lysate FIOPC | Gb3 Depletion FIOPC |
|---|---|---|---|---|---|
| 523/524 | P10T/E39M/R44L/T47S/P337A | + | | | |
| 525/526 | P10T/R44L/H92Y | ++ | | | |
| 527/528 | R44L/T47S/P166S | + | | | |
| 529/530 | A206K/R217F | ++ | | | |
| 531/532 | E39M/T47S/H92Y/T392M | | + | | |
| 533/534 | P10T/E39M/H92Y/W131G/P166S/A271H/D316L/I322M | + | | + | |
| 535/536 | E39M/T47S/R217F/D247N/A368W | | | | + |
| 537/538 | H92Y/P166S/D247N | | | | + |
| 539/540 | H92Y/R217F | | | | + |
| 541/542 | P10T/A206K | | | | ++ |
| 543/544 | P10T/D316L/T392M | | | | ++ |
| 545/546 | P10T/E39M/R44L/H92Y/P166S/G261A/D316L/I322M | | | | + |
| 547/548 | P10T/E39M/R44L/H92Y/P166S/K302Q/I322M | | | | + |
| 549/550 | P10T/E39M/R44L/H92Y/R217F/K302Q/I322M | | | | + |
| 551/552 | P10T/E39M/R44L/T47S/D316L | | | | + |
| 553/554 | P10T/E39M/R44L/T47S/H92Y/A206K/R217F | | | | ++ |
| 555/556 | P10T/H92Y/K302Q/P337A | | | | + |
| 557/558 | P10T/R44L/H92Y/R217F/D247N/A271H/K302Q/D316L/T392M | | | | + |
| 559/560 | P10T/R44L/T47S/P166S/A271H/I322M/A368W | | | | ++ |
| 561/562 | P10T/R44L/T47S/R217F/A271H/D316L/I322M | | | | + |
| 563/564 | R44L/T47S/H92Y/T392M | | | | + |
| 565/566 | T47S/A271H | | | | ++ |
| 567/568 | T47S/P166S/A206K/R217F/D247N/P337A | | | | + |
| 569/570 | E39M/R44L/P166S/A271H/P337A/A368W/T392M | | | | + |
| 571/572 | E39M/R44L/T47S/H92Y/P166S/A206K/T392M | | | | + |

TABLE 9-1-continued

Relative Performance of GLA Variants
(Relative to SEQ ID NO: 374)[1]

| SEQ ID NO: (nt/aa) | Amino Acid Differences (Relative to SEQ ID NO: 374) | Unchallenged FIOPC | Stability FIOPC | Lysate FIOPC | Gb3 Depletion FIOPC |
|---|---|---|---|---|---|
| 573/574 | H92Y/A206K/I322M | | | | + |
| 575/576 | P10T/E39M/R44L/H92Y/K302Q/I322M | | | | + |
| 577/578 | P10T/E39M/R44L/T392M | | | | + |
| 579/580 | R44L/T47S | | | | + |
| 581/582 | D247N/D316L | | | | + |
| 583/584 | D316L/P337A/T392M | | | | + |
| 585/586 | D52N/R217F/K302Q/D316L | | | | + |
| 587/588 | H92Y/P166S/A206K/A271H/D316L | | | | + |
| 589/590 | P10T/G261A/P337A/T392M | | | | + |
| 591/592 | P10T/K36M/H92Y/P166S/D247N/G261A/D316L/T392M | | | | ++ |
| 593/594 | H92Y/R217F/A271H/P337A | | | | ++ |
| 595/596 | P10T/A368W | | | | + |
| 597/598 | P10T/E39M/H92Y/P166S/R217F/D247N/A271H | | | | + |
| 599/600 | P10T/R44L/T47S/P166S/G261A/A271H | | | | + |
| 601/602 | R44L/D316L/I322M/T392M | | | | ++ |
| 603/604 | E39M/R44L/T47S/A206K/P337A/A368W/T392M | + | | | ++ |
| 605/606 | P10T/R44L/A206K/D316L/I322M | + | | | + |
| 607/608 | E39M/R44L/P166S/A271H | ++ | | | ++ |
| 609/610 | E39M/T47S/D247N | ++ | | | + |
| 611/612 | P10T/A206K/D247N/G261A | +++ | | | ++ |
| 613/614 | P10T/E39M/R44L/H92Y/P166S/T392M | + | | | ++ |
| 615/616 | P10T/R44L/P166S/K302Q | +++ | | | ++ |
| 617/618 | P10T/T47S/H92Y/A271H/K302Q | + | | | + |
| 619/620 | R44L/T47S/P166S/A271H | ++ | | | ++ |
| 621/622 | E39M/R44L/T47S/H92Y/A206K/D247N/G261A | +++ | +++ | | ++ |
| 623/624 | E39M/R44L/T47S/H92Y/A206K/T392M | +++ | ++++ | | +++ |
| 625/626 | P10T/E39M/T47S/H92Y/P337A | ++ | +++ | | + |
| 627/628 | P10T/H92Y/P166S/R217F/D247N/G261A/A271H | | | ++ | + |
| 629/630 | P10T/T47S/P166S/D316L | | | + | ++ |
| 631/632 | P10T/T47S/H92Y/D316L/I322M/T392M | | | ++ | ++ |
| 633/634 | R217F/T392M | | | ++ | + |
| 635/636 | E39M/P166S/R217F/G261A/D316L/A368W | | | +++ | +++ |
| 637/638 | E39M/T47S/P166S/R217F/G261A/T392M | | | ++ | ++ |
| 639/640 | P10T/E39M/H92Y/R217F/D316L | | | +++ | ++ |
| 641/642 | D316L/I322M/A368W | + | | +++ | ++ |
| 643/644 | H92Y/P166S/D316L | + | | +++ | +++ |
| 645/646 | H92Y/P166S/R217F/D316L/P337A/T392M | + | | +++ | +++ |
| 647/648 | H92Y/P166S/R217F/G261A/A271H/T392M | +++ | | +++ | +++ |
| 649/650 | P10T/H92Y/D316L/I322M | +++ | | ++++ | +++ |
| 651/652 | P10T/H92Y/P166S | + | | ++ | +++ |
| 653/654 | P10T/H92Y/P166S/P337A/A368W | + | | ++ | ++ |
| 655/656 | P10T/R217F/I322M | + | | +++ | +++ |
| 657/658 | P10T/T47S/H92Y/P166S/A271H/D316L/P337A | + | | +++ | ++ |
| 659/660 | P10T/T47S/P166S/A271H | ++ | | ++ | ++ |
| 661/662 | P166S/D247N/A271H/D316L | + | | ++ | + |
| 663/664 | P166S/D316L/I322M/P337A | + | | + | + |
| 665/666 | P166S/R217F/D316L/I322M/P337A | + | | +++ | ++ |
| 667/668 | R44L/T47S/D247N/A271H/T392M | +++ | | +++ | ++ |
| 669/670 | T47S/A206K | +++ | | + | +++ |
| 671/672 | T47S/P166S/R217F/A271H/P337A | + | | + | +++ |
| 673/674 | R44L/T47S/H92Y/R217F/A271H | ++ | | +++ | +++ |
| 675/676 | H92Y/G261A/A271H | | | +++ | ++ | ++ |
| 677/678 | P10T/E39M/R44L/P166S/G261A/A271H/D316L/I322M | | | + | ++ | +++ |
| 679/680 | P10T/H92Y/P166S/G261A/A271H/T392M | | | +++ | + | +++ |
| 681/682 | T47S/R217F/D247N/G261A | | | + | +++ | + |
| 683/684 | E39M/H92Y/G261A/K302Q | +++ | ++++ | + | + |

TABLE 9-1-continued

Relative Performance of GLA Variants
(Relative to SEQ ID NO: 374)[1]

| SEQ ID NO: (nt/aa) | Amino Acid Differences (Relative to SEQ ID NO: 374) | Unchallenged FIOPC | Stability FIOPC | Lysate FIOPC | Gb3 Depletion FIOPC |
|---|---|---|---|---|---|
| 685/686 | E39M/H92Y/ P166S/R217F/ T392M | +++ | +++ | +++ | ++ |
| 687/688 | E39M/I322M | +++ | +++ | ++ | ++ |
| 689/690 | E39M/R44L/ H92Y/P166S/ 2D47N/G261A/ K302Q/P337A | +++ | ++++ | + | + |
| 691/692 | E39M/T392M | + | +++ | ++ | + |
| 693/694 | E39M/T47S/ H92Y/D316L/ I322M | + | +++ | + | + |
| 695/696 | H92Y/A271H | +++ | ++++ | ++++ | +++ |
| 697/698 | P10T/E39M | +++ | +++ | ++++ | +++ |
| 699/700 | P10T/G261A | ++ | ++++ | +++ | ++ |
| 701/702 | P10T/H92Y/ P166S/G261A/ D316L/I322M/ P337A | ++ | +++ | +++ | +++ |
| 429/430 | R44L/P337A | + | + | + | +++ |
| 431/432 | R44L/T47S/ H92Y/R217F/ D316L/I322M/ T392M | +++ | ++ | +++ | +++ |

[1] All activities were determined relative to the reference polypeptide of SEQ ID NO: 374. Levels of increased activity are defined as follows: "+" = 0.75-0.9; "++" > 0.9; "+++" > 1.1; and "++++" > 2.

Example 10

In Vivo Characterization of GLA Variants

Figure 5:
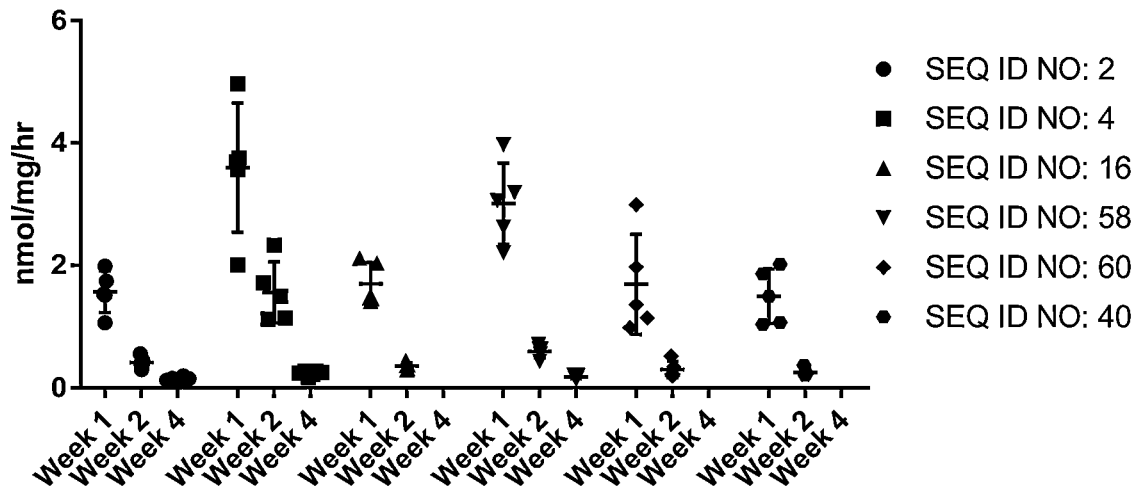
FIG. 5 provides a graph showing the activity of GLA variants in the heart of the Fabry mice compared to SEQ ID NO: 2 at 1, 2, and 4 weeks post-administration.
Figure 6:
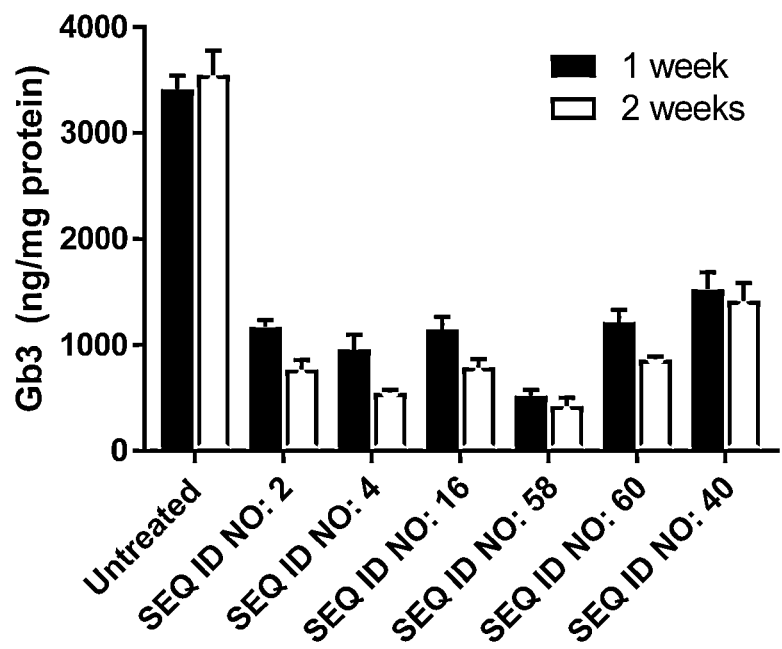
FIG. 6 provides a graph showing residual $Gb_3$ in the heart of Fabry mice treated with GLA variants at 1 and 2 weeks post-administration.

GLA variants were characterized in vivo for their activity towards accumulated Gb3. Fabry mice (5 month old females; Jackson, stock #3535) and age/sex matched wild-type mice with the identical genetic background were used. Mice were administered a single IV injection via tail vein with Codexis enzyme variants (1.0 mg/kg). Animals were sacrificed using $CO_2$ anesthesia at scheduled time points (1 and 2 weeks post-injection), and disease relevant tissues (e.g., heart and kidney) were dissected into two portions (one for enzyme activity assay, the other for Gb3 quantification), frozen on dry ice, and stored at −80° C. until analysis. For the enzyme assay, mouse tissues were homogenized in 20× volume (w/v) in Lysis Buffer (0.2% TRITON X100™ non-ionic surfactant (Sigma #93443) diluted in 1×PBS) using motor-driven TEFLON® coated pestle in a glass homogenizer. Lysates were sonicated, centrifuged at 14,000 rpm for 15 min at 4° C., and the supernatants used for enzyme assay. α-Gal A activity was measured by the standard fluorimetric assay using 5 mM 4-methylumbelliferyl-α-D-galactopyranoside at pH 4.4, in the presence of 0.1M N-acetylgalactosamine (i.e., a specific inhibitor of α-galactosidase B). Protein concentrations were measured using the BCA protein assay kit (Pierce, #23225). The activity was normalized to the protein concentration and expressed as nmol/mg protein/hour. Gb3 concentrations were measured by mass-spectrometry as previously described (See, Durant et al., J. Lipid Res., 52:1742-6 [2011]). Briefly, mouse tissues were homogenized in ice-cold 20× volume of ultra-pure water in a glass homogenizer, and the lysates corresponding to 200 µg total protein were subjected to glycosphingolipid extraction, saponification, and subsequent analysis of $Gb_3$ by mass-spectrometry. The $Gb_3$ concentration was be expressed as ng/mg protein. FIG. 5 provides a graph showing in vivo enzyme activity in the heart in the Fabry mouse model 1, 2 and 4 weeks post-treatment. FIG. 6. provides a graph of Gb3 degradation in heart tissue in Fabry mouse models 1 and 2 weeks post-treatment compared to untreated animals

SEQUENCE LISTING (702 sequences)

SEQ ID NO: 1 - DNA, 1194 bp, Artificial Sequence
  wild type human alpha-galactosidase A
ttggataacgggttagcccgtacacctactatgggttggcttcactgggaaagattcatgtgtaacttagattgccaagaagagcctgacagctgtatctcagagaaactattcatggagatggctgaactaatggtaagtgaaggatggaaggatgctggttatgaatacctatgtattgatgattgctggatggctccacagcgtgattcagaaggtaggttacaagctgacccccagagattcccacatggcatacgtcagcttgcaaactacgtacacagcaagggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggagcatcgtctatagttgtgaatggcccttgtacatgtggccgtttcagaagccaaactacactgagataagacaatactgtaaccattggcgtaactttgctgacatagatgattcatggaagtcaatcaaatctatcttggattggacttctttcaaccaggaaagaattgttgatgttgcaggtccaggtggatggaatgaccctgatatgcttgtcatagggaactttgggctatcatggaatcaacaagttacacaaatggctttgtgggcgatcatggccgcacccctattcatgtctaatgatctacgtcacatatcaccccaagcaaaggctttacttcaagataaggatgtcatagcgatcaaccaagatcctcttggtaaacaaggttatcaattgagacaaggtgacaactttgaagtgtgggaaagaccattgtctggacttgcgtgggctgttgctatgatcaaccgtcaagagatcggagggccaagatcttacactatcgcggtagcctctttgggtaagggtgttgcgtgcaatcctgcctgcttcattacacaattgcttccagttaagagaaagttgggtttctatgagtggacatctaggctaagaagtcacatcaatcctactggtacggtattgttgcaattggagaacacaatgcaaatgtctttgaaagatttgtta

SEQ ID NO: 2 - protein, 398 aa, Artificial Sequence
  wild type human alpha-galactosidase A
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 3 - DNA, 1194 bp, Artificial Sequence
  variant of human alpha-galactosidase A
ttggataacgggttagcccgtacacctactatgggttggcttcactgggaaagattcatgtgtaacttagattgccaagaagagcctgacagctgtatctcagagaaactattcatggagatggctgaacggatggtaagtgaaggatggaaggatgctggttatgaatacctatgtattgatgattgctggatggctccacagcgtgattcagaaggtaggttacaagctgacccccagagattcccacatggcatacgtcagcttgcaaactacgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccgcacccctattcatgtctaatgatctacgtcacatatcaccccaagcaaaggctttacttcaagataaggatgtcatagcgatcaaccaagatcctcttggtaaacaaggttatcaattgagaaaaggtgacaactttgaagtgtgggaaagaccattgtctggagatgcgtgggctgttgctattatcaaccgtcaagagatcggagggccaagatcttacactatcccggtagcctctttgggtaagggtgttgcgtgcaatcctgcctgcttcattacacaattgcttccagttaagagacaattgggtttctatgaatggacctctaggctaaaaagtcacattaatcctactggtacggtattgttgcaattggagaacacaatgcaaatgtctttgaaagatttgtta

SEQ ID NO: 4 - protein, 398 aa, Artificial Sequence
  variant of human alpha-galactosidase A
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYEWTSRLKSHINPTGTVLLQLENTMQMSLKDLL

SEQ ID NO: 5 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagatgcgtgggctgttgctattatcaaccgtcaagagatcggagggccaagatcttacactatcccggtagcctctttgggtaagggtgttgcgtgcaatcctgcctgcttcattacacaattgcttccagttaagagacaattgggtttctataacgcaacctctaggctaaaaagtcacattaatcctactggtacggtattgttgcaattggagaacacaatgcaaacctctttgaaagatttgtta

SEQ ID NO: 6 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNATSRLKSHINPTGTVLLQLENTMQTSLKDLL

SEQ ID NO: 7 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagatgcgtgggctgttgctattatcaaccgtcaagagatcggagggccaagatcttacactatcccggtagcctctttgggtaagggtgttgcgtgcaatcctgcctgcttcattacacaattgcttccagttaagagacaattgggtttctatgaagcaacctctaggctaaaaagtcacattaatcctactggtacggtattgttgcaattggagaacacaatgcaaacctctttgaaagatttgtta

SEQ ID NO: 8 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYEATSRLKSHINPTGTVLLQLENTMQTSLKDLL

SEQ ID NO: 9 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaactgatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgcaaccaggaaagaattgttgatgttgcaggtccaggtggatggaatgaccctgatatgcttgtcatagggaactttgggctatcatggaaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcgcggtagcctctttgggtaagggtgttgcgtgcaatcctgcctgcttcattacacaattgcttccagttaagagacaattgggtttctatgaagcaacctctaggctaaaaagtcacattaatcctactggtacggtattgttgcaattggagaacacaatgcaaacctctttgaaagatttgtta

SEQ ID NO: 10 - protein, 398 aa, Artificial Sequence
  variant of human alpha-galactosidase A
LDNGLARTPPMGWLHWERFMCNLDCQEEPDSCISEKLFEEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWNQQVTQMALWAIMAGPLFMSNDLRAISPQAKALLQDKDVIAINQDPLGKQGYQLRKGDNFEVWERPLSGDAWAVAIINRQEIGGPRSYTIAVASLGKGVACNPACFITQLLPVKRQLGFYEATSRLKSHINPTGTVLLQLENTMQTSLKDLL

SEQ ID NO: 11 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaactgatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagacaaggtgacaactttgaagtgtgggaaagaccattgtctggagatgcgtgggctgttgctattatcaaccgtcaagagatcggagggccaagatcttacactatcccggtagcctctttgggtaagggtgttgcgtgcaatcctgcctgcttcattacacaattgcttccagttaagagacaattgggtttctatgaagcaacctctaggctaaaaagtcacattaatcctactggtacggtattgttgcaattggagaacacaatgcaaacctctttgaaagatttgtta

SEQ ID NO: 12 - protein, 398 aa, Artificial Sequence
  variant of human alpha-galactosidase A
LDNGLARTPPMGWLHWERFMCNLDCQEEPDSCISEKLFEEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRQGDNFEVWERPLSGDAWAVAIINRQEIGGPRSYTIPVASLGKGVACNPACFITQLLPVKRQLGFYEATSRLKSHINPTGTVLLQLENTMQTSLKDLL

SEQ ID NO: 13 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaactgatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatggaaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagacaaggtgacaactttgaagtgtgggaaagaccattgtctggagatgcgtgggctgttgctattatcaaccgtcaagagatcggagggccaagatcttacactatcccggtagcctctttgggtaagggtgttgcgtgcaatcctgcctgcttcattacacaattgcttccagttaagagacaattgggtttctatgaagcaacctctaggctaaaaagtcacattaatcctactggtacggtattgttgcaattggagaacacaatgcaaacctctttgaaagatttgtta

SEQ ID NO: 14 - protein, 398 aa, Artificial Sequence
  variant of human alpha-galactosidase A
LDNGLARTPPMGWLHWERFMCNLDCQEEPDSCISEKLFEEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWNQQVTQMALWAIMAGPLFMSNDLRAISPQAKALLQDKDVIAINQDPLGKQGYQLRQGDNFEVWERPLSGDAWAVAIINRQEIGGPRSYTIPVASLGKGVACNPACFITQLLPVKRQLGFYEATSRLKSHINPTGTVLLQLENTMQTSLKDLL

SEQ ID NO: 15 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttcttttaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagatgcgtgggctgttgctattatcaaccgtcaagagatcggagggccaagatcttacactatcccggtagcctctttgggtaagggtgttgcgtgcaatcctgcctgcttcattacacaattgcttccagttaagagacaattgggtttctatgaagcaacctctaggctaagaagtcacattaatcctactggtacggtattgttgcaattggagaacacaatgcaaacctctttgaaagatttgtta

SEQ ID NO: 16 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSFNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYEATSRLRSHINPTGTVLLQLENTMQTSLKDLL

SEQ ID NO: 17 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagatgcgtgggctgttgctatgatcaaccgtcaagagatcggagggccaagatcttacactatcgcggtagcctctttgggtaagggtgttgcgtgcaatcctgcctgcttcattacacaattgcttccagttaagagacaattgggtttctatgaagcaacctctaggctaaaaagtcacattaatcctactggtacggtattgttgcaattggagaacacaatgcaaacctctttgaaagatttgtta

SEQ ID NO: 18 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAMINRQEIGGPRSYTIAVASLGKGVACNPACFITQLLPVKRQLGFYEATSRLKSHINPTGTVLLQLENTMQTSLKDLL

SEQ ID NO: 19 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaactgatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatggaaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagacaaggtgacaactttgaagtgtgggaaagaccattgtctggagatgcgtgggctgttgctatgatcaaccgtcaagagatcggagggccaagatcttacactatcccggtagcctctttgggtaagggtgttgcgtgcaatcctgcctgcttcattacacaattgcttccagttaagagacaattgggtttctatgaagcaacctctaggctaaaaagtcacattaatcctactggtacggtattgttgcaattggagaacacaatgcaaacctctttgaaagatttgtta

SEQ ID NO: 20 - protein, 398 aa, Artificial Sequence
  variant of human alpha-galactosidase A
LDNGLARTPPMGWLHWERFMCNLDCQEEPDSCISEKLFEEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWNQQVTQMALWAIMAGPLFMSNDLRAISPQAKALLQDKDVIAINQDPLGKQGYQLRQGDNFEVWERPLSGDAWAVAMINRQEIGGPRSYTIPVASLGKGVACNPACFITQLLPVKRQLGFYEATSRLKSHINPTGTVLLQLENTMQTSLKDLL

SEQ ID NO: 21 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagacaaggtgacaactttgaagtgtgggaaagaccattgtctggagatgcgtgggctgttgctatgatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgtta

SEQ ID NO: 22 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRQGDNFEVWERPLSGDAWAVAMINRQEIGGPRSYTIPVASLGKGVACNPACFITQLLPVKRKLGFYEATSRLRSHINPTGTVLLQLENTMQTSLKDLL

SEQ ID NO: 23 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagatgcgtgggctgttgctatgatcaaccgtcaagagatcggagggccaagatcttacactatcccggtagcctctttgggtaagggtgttgcgtgcaatcctgcctgcttcattacacaattgcttccagttaagagacaattgggtttctatgaagcaacctctaggctaaaaagtcacattaatcctactggtacggtattgttgcaattggagaacacaatgcaaacctctttgaaagatttgtta

SEQ ID NO: 24 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAMINRQEIGGPRSYTIPVASLGKGVACNPACFITQLLPVKRQLGFYEATSRLKSHINPTGTVLLQLENTMQTSLKDLL

SEQ ID NO: 25 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagacaaggtgacaactttgaagtgtgggaaagaccattgtctggagacgcgtgggctgttgctattatcaaccgtcaagagatcggagggccaagatcttacactatcgcggtagcctctttgggtaagggtgttgcgtgcaatcctgcctgcttcattacacaattgcttccagttaagagacaattgggtttctatgaagcaacctctaggctaaaaagtcacattaatcctactggtacggtattgttgcaattggagaacacaatgcaaacctctttgaaagatttgtta

SEQ ID NO: 26 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRQGDNFEVWERPLSGDAWAVAIINRQEIGGPRSYTIAVASLGKGVACNPACFITQLLPVKRQLGFYEATSRLKSHINPTGTVLLQLENTMQTSLKDLL

SEQ ID NO: 27 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaactgatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttcttttaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagatgcgtgggctgttgctatgatcaaccgtcaagagatcggagggccaagatcttacactatcccggtagcctctttgggtaagggtgttgcgtgcaatcctgcctgcttcattacacaattgcttccagttaagagacaattgggtttctatgaagcaacctctaggctaaaaagtcacattaatcctactggtacggtattgttgcaattggagaacacaatgcaaacctctttgaaagatttgtta

SEQ ID NO: 28 - protein, 398 aa, Artificial Sequence
  variant of human alpha-galactosidase A
LDNGLARTPPMGWLHWERFMCNLDCQEEPDSCISEKLFEEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSFNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAMINRQEIGGPRSYTIPVASLGKGVACNPACFITQLLPVKRQLGFYEATSRLKSHINPTGTVLLQLENTMQTSLKDLL

SEQ ID NO: 29 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaactgatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatggaaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagatgcgtgggctgttgctatgatcaaccgtcaagagatcggagggccaagatcttacactatcccggtagcctctttgggtaagggtgttgcgtgcaatcctgcctgcttcattacacaattgcttccagttaagagacaattgggtttctatgaagcaacctctaggctaaaaagtcacattaatcctactggtacggtattgttgcaattggagaacacaatgcaaacctctttgaaagatttgtta

SEQ ID NO: 30 - protein, 398 aa, Artificial Sequence
  variant of human alpha-galactosidase A
LDNGLARTPPMGWLHWERFMCNLDCQEEPDSCISEKLFEEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWNQQVTQMALWAIMAGPLFMSNDLRAISPQAKALLQDKDVIAINQDPLGKQGYQLRKGDNFEVWERPLSGDAWAVAMINRQEIGGPRSYTIPVASLGKGVACNPACFITQLLPVKRQLGFYEATSRLKSHINPTGTVLLQLENTMQTSLKDLL

SEQ ID NO: 31 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaactgatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgcaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcgcggtagcctctttgggtaagggtgttgcgtgcaatcctgcctgcttcattacacaattgcttccagttaagagacaattgggtttctatgaagcaacctctaggctaaaaagtcacattaatcctactggtacggtattgttgcaattggagaacacaatgcaaacctctttgaaagatttgtta

SEQ ID NO: 32 - protein, 398 aa, Artificial Sequence
  variant of human alpha-galactosidase A
LDNGLARTPPMGWLHWERFMCNLDCQEEPDSCISEKLFEEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIAVASLGKGVACNPACFITQLLPVKRQLGFYEATSRLKSHINPTGTVLLQLENTMQTSLKDLL

SEQ ID NO: 33 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaactgatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagacaattgggtttctatgaagcaacctctaggctaagaagtcacattaatcctactggtacggtattgttgcaattggagaacacaatgcaaacctctttgaaagatttgtta

SEQ ID NO: 34 - protein, 398 aa, Artificial Sequence
  variant of human alpha-galactosidase A
LDNGLARTPPMGWLHWERFMCNLDCQEEPDSCISEKLFEEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYEATSRLRSHINPTGTVLLQLENTMQTSLKDLL

SEQ ID NO: 35 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaactgatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatggaaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagatgcgtgggctgttgctattatcaaccgtcaagagatcggagggccaagatcttacactatcccggtagcctctttgggtaagggtgttgcgtgcaatcctgcctgcttcattacacaattgcttccagttaagagacaattgggtttctatgaagcaacctctaggctaaaaagtcacattaatcctactggtacggtattgttgcaattggagaacacaatgcaaacctctttgaaagatttgtta

SEQ ID NO: 36 - protein, 398 aa, Artificial Sequence
  variant of human alpha-galactosidase A
LDNGLARTPPMGWLHWERFMCNLDCQEEPDSCISEKLFEEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWNQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYEATSRLKSHINPTGTVLLQLENTMQTSLKDLL

SEQ ID NO: 37 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttcttttaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagatgcgtgggctgttgctatgatcaaccgtcaagagatcggagggccaagatcttacactatcccggtagcctctttgggtaagggtgttgcgtgcaatcctgcctgcttcattacacaattgcttccagttaagagacaattgggtttctatgaagcaacctctaggctaaaaagtcacattaatcctactggtacggtattgttgcaattggagaacacaatgcaaacctctttgaaagatttgtta

SEQ ID NO: 38 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSFNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAMINRQEIGGPRSYTIPVASLGKGVACNPACFITQLLPVKRQLGFYEATSRLKSHINPTGTVLLQLENTMQTSLKDLL

SEQ ID NO: 39 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaactgatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttcttttaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggattagcgtgggctgttgctattatcaaccgtcaagagatcggagggccaagatcttacactatcccggtagcctctttgggtaagggtgttgcgtgcaatcctgcctgcttcattacacaattgcttccagttaagagacaattgggtttctatgaagcaacctctaggctaaaaagtcacattaatcctactggtacggtattgttgcaattggagaacacaatgcaaacctctttgaaagatttgtta

SEQ ID NO: 40 - protein, 398 aa, Artificial Sequence
  variant of human alpha-galactosidase A
LDNGLARTPPMGWLHWERFMCNLDCQEEPDSCISEKLFEEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSFNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGLAWAVAIINRQEIGGPRSYTIPVASLGKGVACNPACFITQLLPVKRQLGFYEATSRLKSHINPTGTVLLQLENTMQTSLKDLL

SEQ ID NO: 41 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatggaaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagatgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaaaaagtcacattaatcctactggtacggtattgttgcaattggagaacacaatgcaaacctctttgaaagatttgtta

SEQ ID NO: 42 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWNQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLKSHINPTGTVLLQLENTMQTSLKDLL

SEQ ID NO: 43 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaactgatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttcttttaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagatgcgtgggctgttgctattatcaaccgtcaagagatcggagggccaagatcttacactatcccggtagcctctttgggtaagggtgttgcgtgcaatcctgcctgcttcattacacaattgcttccagttaagagacaattgggtttctatgaagcaacctctaggctaaaaagtcacattaatcctactggtacggtattgttgcaattggagaacacaatgcaaacctctttgaaagatttgtta

SEQ ID NO: 44 - protein, 398 aa, Artificial Sequence
  variant of human alpha-galactosidase A
LDNGLARTPPMGWLHWERFMCNLDCQEEPDSCISEKLFEEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSFNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYEATSRLKSHINPTGTVLLQLENTMQTSLKDLL

SEQ ID NO: 45 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagatgcgtgggctgttgctattatcaaccgtcaagagatcggagggccaagatcttacactatcccggtagcctctttgggtaagggtgttgcgtgcaatcctgcctgcttcattacacaattgcttccagttaagagacaattgggtttctatgaagcaacctctaggctaagaagtcacattaatcctactggtacggtattgttgcaattggagaacacaatgcaaacctctttgaaagatttgtta

SEQ ID NO: 46 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYEATSRLRSHINPTGTVLLQLENTMQTSLKDLL

SEQ ID NO: 47 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatggaaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctatgatcaaccgtcaagagatcggagggccaagatcttacactatcccggtagcctctttgggtaagggtgttgcgtgcaatcctgcctgcttcattacacaattgcttccagttaagagacaattgggtttctatgaagcaacctctaggctaaaaagtcacattaatcctactggtacggtattgttgcaattggagaacacaatgcaaacctctttgaaagatttgtta

SEQ ID NO: 48 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWNQQVTQMALWAIMAGPLFMSNDLRAISPQAKALLQDKDVIAINQDPLGKQGYQLRKGDNFEVWERPLSGDAWAVAMINRQEIGGPRSYTIPVASLGKGVACNPACFITQLLPVKRQLGFYEATSRLKSHINPTGTVLLQLENTMQTSLKDLL

SEQ ID NO: 49 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaactgatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagatgcgtgggctgttgctattatcaaccgtcaagagatcggagggccaagatcttacactatcccggtagcctctttgggtaagggtgttgcgtgcaatcctgcctgcttcattacacaattgcttccagttaagagacaattgggtttctatgaagcaacctctaggctaaaaagtcacattaatcctactggtacggtattgttgcaattggagaacacaatgcaaacctctttgaaagatttgtta

SEQ ID NO: 50 - protein, 398 aa, Artificial Sequence
  variant of human alpha-galactosidase A
LDNGLARTPPMGWLHWERFMCNLDCQEEPDSCISEKLFEEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYEATSRLKSHINPTGTVLLQLENTMQTSLKDLL

SEQ ID NO: 51 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggattagcgtgggctgttgctattatcaaccgtcaagagatcggagggccaagatcttacactatcccggtagcctctttgggtaagggtgttgcgtgcaatcctgcctgcttcattacacaattgcttccagttaagagacaattgggtttctatgaagcaacctctaggctaaaaagtcacattaatcctactggtacggtattgttgcaattggagaacacaatgcaaacctctttgaaagatttgtta

SEQ ID NO: 52 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGLAWAVAIINRQEIGGPRSYTIPVASLGKGVACNPACFITQLLPVKRQLGFYEATSRLKSHINPTGTVLLQLENTMQTSLKDLL

SEQ ID NO: 53 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaactgatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatggaaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagatgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaaaaagtcacattaatcctactggtacggtattgttgcaattggagaacacaatgcaaacctctttgaaagatttgtta

SEQ ID NO: 54 - protein, 398 aa, Artificial Sequence
  variant of human alpha-galactosidase A
LDNGLARTPPMGWLHWERFMCNLDCQEEPDSCISEKLFEEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWNQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLKSHINPTGTVLLQLENTMQTSLKDLL

SEQ ID NO: 55 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggattagcgtgggctgttgctattatcaaccgtcaagagatcggagggccaagatcttacactatcgcggtagcctctttgggtaagggtgttgcgtgcaatcctgcctgcttcattacacaattgcttccagttaagagacaattgggtttctatgaagcaacctctaggctaaaaagtcacattaatcctactggtacggtattgttgcaattggagaacacaatgcaaacctctttgaaagatttgtta

SEQ ID NO: 56 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGLAWAVAIINRQEIGGPRSYTIAVASLGKGVACNPACFITQLLPVKRQLGFYEATSRLKSHINPTGTVLLQLENTMQTSLKDLL

SEQ ID NO: 57 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgtta

SEQ ID NO: 58 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 59 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaactgatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttcttttaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagatgcgtgggctgttgctatgatcaaccgtcaagagatcggagggccaagatcttacactatcgcggtagcctctttgggtaagggtgttgcgtgcaatcctgcctgcttcattacacaattgcttccagttaagagacaattgggtttctatgaagcaacctctaggctaaaaagtcacattaatcctactggtacggtattgttgcaattggagaacacaatgcaaacctctttgaaagatttgtta

SEQ ID NO: 60 - protein, 398 aa, Artificial Sequence
  variant of human alpha-galactosidase A
LDNGLARTPPMGWLHWERFMCNLDCQEEPDSCISEKLFEEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSFNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAMINRQEIGGPRSYTIAVASLGKGVACNPACFITQLLPVKRQLGFYEATSRLKSHINPTGTVLLQLENTMQTSLKDLL

SEQ ID NO: 61 - DNA, 1194 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtagggcgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagatgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaaaaagtcacattaatcctactggtacggtattgttgcaattggagaacacaatgcaaacctctttgaaagatttgtta

SEQ ID NO: 62 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRAIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLKSHINPTGTVLLQLENTMQTSLKDLL

SEQ ID NO: 63 - DNA, 100 bp, Artificial Sequence
  BamHI-pCDNA-GLA-F
acgtttggatcccgccaccatggaatggagctgggtctttctcttcttcctgtcagtaacgactggtgtccactccttggataacgggttagcccgtaca

SEQ ID NO: 64 - DNA, 35 bp, Artificial Sequence
  XhoI-pCDNA-GLA-R
attgtactcgagttataacaaatctttcaaagaca

SEQ ID NO: 65 - DNA, 57 bp, Artificial Sequence
  synthetic mouse IG signal peptide
atggaatggagctgggtctttctcttcttcctgtcagtaacgactggtgtccactcc

SEQ ID NO: 66 - protein, 19 aa, Artificial Sequence
  synthetic mouse IG signal peptide
MEWSWVFLFFLSVTTGVHS

SEQ ID NO: 67 - DNA, 1197 bp, Artificial Sequence
  variant of human alpha-galactosidase A
ttggataacgggttagccctgacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcatttggtcactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagacaaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 68 - protein, 398 aa, Artificial Sequence
  variant of human alpha-galactosidase A
LDNGLALTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGHYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 69 - DNA, 1197 bp, Artificial Sequence
  variant of human alpha-galactosidase A
ttggataacgggttagccctgacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagacaaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtgtctatgaagcaacctctaggctaagaagtcacattaatcctactggtacggtattgttgcaattggagaacacaatgcaaacctctttgaaagatttgttataa

SEQ ID NO: 70 - protein, 398 aa, Artificial Sequence
  variant of human alpha-galactosidase A
LDNGLALTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGVYEATSRLRSHINPTGTVLLQLENTMQTSLKDLL

SEQ ID NO: 71 - DNA, 1197 bp, Artificial Sequence
  variant of human alpha-galactosidase A
ttggataacgggttagccctgacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtgcccttgcaaaccatgtacacagcaaaggtctaaagttaggcatctacgctgatgtcggaaacaagacatgtgctggtttcccaggttcatttggtcactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagacaaggatgtcatagcgatcaaccaagatcctcttggtaaacaaggttatcaattgagaaaaggtgacgggtttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtgtctatgaagcaacctctaggctaagaagtcacattaatcctactggtacggtattgttgcaattggagaacacaatgcaaacctctttgaaagatttgttataa

SEQ ID NO: 72 - protein, 398 aa, Artificial Sequence
  variant of human alpha-galactosidase A
LDNGLALTPPMGWLHWERFMCNLDCQEEPDSCISEKLFEEMAERMVTEGWKDAGYEYLCIDDCWMAPQRDSEGRLQADPQRFPHGIRALANHVHSKGLKLGIYADVGNKTCAGFPGSFGHYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDGFEVWERPLSGDAWAVAIINRQEIGGPRSYTIPVASLGKGVACNPACFITQLLPVKRKLGVYEATSRLRSHINPTGTVLLQLENTMQTSLKDLL

SEQ ID NO: 73 - DNA, 1197 bp, Artificial Sequence
  variant of human alpha-galactosidase A
ttggataacgggttagccctgacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacgggtttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 74 - protein, 398 aa, Artificial Sequence
  variant of human alpha-galactosidase A
LDNGLALTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDGFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 75 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtgcccttgcaaaccatgtacacagcaaaggtctaaagttaggcatctacgctgatgtcggaaacaagacatgtgctggtttcccaggttcatttggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 76 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRALANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 77 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaaaacaaggatgtcatagcgatcaaccaagatcctcttggtaaacaaggttatcaattgagaaaaggtgacaattttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 78 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQNKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 79 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcgtatcagaaaaggtgacaattttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 80 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYRIRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 81 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcatttggtcactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagacaaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 82 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGHYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 83 - DNA, 1197 bp, Artificial Sequence
  variant of human alpha-galactosidase A
ttggataacgggttagccctgacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagacaaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 84 - protein, 398 aa, Artificial Sequence
  variant of human alpha-galactosidase A
LDNGLALTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 85 - DNA, 1197 bp, Artificial Sequence
  variant of human alpha-galactosidase A
ttggataacgggttagccctgacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacgggtttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtgtctatgaagcaacctctaggctaagaagtcacattaatcctactggtacggtattgttgcaattggagaacacaatgcaaacctctttgaaagatttgttataa

SEQ ID NO: 86 - protein, 398 aa, Artificial Sequence
  variant of human alpha-galactosidase A
LDNGLALTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDGFEVWERPLSGDAWAVAIINRQEIGGPRSYTIPVASLGKGVACNPACFITQLLPVKRKLGVYEATSRLRSHINPTGTVLLQLENTMQTSLKDLL

SEQ ID NO: 87 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcatttggtcactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcgtctgagaaaaggtgacgggtttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 88 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGHYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYRLRKGDGFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 89 - DNA, 1197 bp, Artificial Sequence
  variant of human alpha-galactosidase A
ttggataacgggttagccctgacacctccgatgggttggcttcactgggaaagattcatgtgtaacttagattgccaagaagagcctgacagctgtatctcagagaaactattcgaagagatggctgaacggatggtaaccgatggatggaaggatgctggttatgaatacctatgtattgatgattgctggatggctccagagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcatttggtcactatgacatagatgcgcagacgtttgctgattggggtgttgatttgttgaagtttgatggatgctactgcgattcgctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaaaacaaggatgtcatagcgatcaaccaagatcctcttggtaaacaaggttatcgtctgagaaaaggtgacaattttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 90 - protein, 398 aa, Artificial Sequence
  variant of human alpha-galactosidase A
LDNGLALTPPMGWLHWERFMCNLDCQEEPDSCISEKLFEEMAERMVTDGWKDAGYEYLCIDDCWMAPERDSEGRLQADPQRFPHGIRQLANHVHSKGLKLGIYADVGNKTCAGFPGSFGHYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQNKDVIAINQDPLGKQGYRLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 91 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgatggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 92 - protein, 398 aa, Artificial Sequence
  variant of human alpha-galactosidase A
LDNGLARTPPMGWLHWERFMCNLDCQEEPDSCISEKLFEEMAERMVTDGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 93 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccagagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 94 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPERDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 95 - DNA, 1197 bp, Artificial Sequence
  variant of human alpha-galactosidase A
ttggataacgggttagccctgacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgagtggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 96 - protein, 398 aa, Artificial Sequence
  variant of human alpha-galactosidase A
LDNGLALTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFAEWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 97 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctacacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattcgctggagaacctagccgatgggtacaaacacatgagtttggctctaaacaggactggtaggccgatcgtctatagttgtgaatggcccttgtacatgtggccgggtcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 98 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMATQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPGQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 99 - DNA, 1197 bp, Artificial Sequence
  variant of human alpha-galactosidase A
ttggataacgggttagccctgacacctccgatgggttggcttcactgggaaagattcatgtgtaacttagattgccaagaagagcctgacagctgtatctcagagaaactattcgaagagatggctgaacggatggtaaccgatggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattcgctggagaacctagccgatgggtacaaacacatgagtttggctctaaacaggactggtaggccgatcgtctatagttgtgaatggcccttgtacatgtggccgggtcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 100 - protein, 398 aa, Artificial Sequence
  variant of human alpha-galactosidase A
LDNGLALTPPMGWLHWERFMCNLDCQEEPDSCISEKLFEEMAERMVTDGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPGQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 101 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagacaaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtgtctatgaagcaacctctaggctaagaagtcacattaatcctactggtacggtattgttgcaattggagaacacaatgcaaacctctttgaaagatttgttataa

SEQ ID NO: 102 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGVYEATSRLRSHINPTGTVLLQLENTMQTSLKDLL

SEQ ID NO: 103 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattcgctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagacaaggatgtcatagcgatcaaccaagatcctcttggtaaacaaggttatcaaatcagaaaaggtgacaattttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 104 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQIRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 105 - DNA, 1197 bp, Artificial Sequence
  variant of human alpha-galactosidase A
ttggataacgggttagccctgacacctccgatgggttggcttcactgggaaagattcatgtgtaacttagattgccaagaagagcctgacagctgtatctcagagaaactattcgaagagatggctgaacggatggtaaccgatggatggaaggatgctggttatgaatacctatgtattgatgattgctggatggctccagagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 106 - protein, 398 aa, Artificial Sequence
  variant of human alpha-galactosidase A
LDNGLALTPPMGWLHWERFMCNLDCQEEPDSCISEKLFEEMAERMVTDGWKDAGYEYLCIDDCWMAPERDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 107 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgatggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcatttggttactatgacatagatgcgcagacgtttgctgattggggtgttgatttgttgaagtttgatggatgctactgcgattcgctggagaacctagccgatgggtacaaacacatgagtttggctctaaacaggactggtaggccgatcgtctatagttgtgaatggcccttgtacatgtggccgggtcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaaaacaaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 108 - protein, 398 aa, Artificial Sequence
  variant of human alpha-galactosidase A
LDNGLARTPPMGWLHWERFMCNLDCQEEPDSCISEKLFEEMAERMVTDGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPGQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQNKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 109 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcatttggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgggtcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 110 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPGQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 111 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcgtatcagaaaaggtgacgggtttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtgtctatgaagcaacctctaggctaagaagtcacattaatcctactggtacggtattgttgcaattggagaacacaatgcaaacctctttgaaagatttgttataa

SEQ ID NO: 112 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYRIRKGDGFEVWERPLSGDAWAVAIINRQEIGGPRSYTIPVASLGKGVACNPACFITQLLPVKRKLGVYEATSRLRSHINPTGTVLLQLENTMQTSLKDLL

SEQ ID NO: 113 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaaaacaaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtgtctatgaagcaacctctaggctaagaagtcacattaatcctactggtacggtattgttgcaattggagaacacaatgcaaacctctttgaaagatttgttataa

SEQ ID NO: 114 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQNKDVIAINQDPLGKQGYQLRKGDNFEVWERPLSGDAWAVAIINRQEIGGPRSYTIPVASLGKGVACNPACFITQLLPVKRKLGVYEATSRLRSHINPTGTVLLQLENTMQTSLKDLL

SEQ ID NO: 115 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgatggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaaaacaaggatgtcatagcgatcaaccaagatcctcttggtaaacaaggttatcaactgagaaaaggtgacgggtttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 116 - protein, 398 aa, Artificial Sequence
  variant of human alpha-galactosidase A
LDNGLARTPPMGWLHWERFMCNLDCQEEPDSCISEKLFEEMAERMVTDGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQNKDVIAINQDPLGKQGYQLRKGDGFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 117 - DNA, 1197 bp, Artificial Sequence
  variant of human alpha-galactosidase A
ttggataacgggttagccctgacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccagagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgggtcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 118 - protein, 398 aa, Artificial Sequence
  variant of human alpha-galactosidase A
LDNGLALTPPMGWLHWERFMCNLDCQEEPDSCISEKLFEEMAERMVTEGWKDAGYEYLCIDDCWMAPERDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPGQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 119 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagacaaggatgtcatagcgatcaaccaagatcctcttggtaaacaaggttatcaactgagaaaaggtgacgggtttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 120 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDGFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 121 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccagagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattcgctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcgtatcagaaaaggtgacaattttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 122 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPERDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYRIRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 123 - DNA, 1197 bp, Artificial Sequence
  variant of human alpha-galactosidase A
ttggataacgggttagccctgacacctccgatgggttggcttcactgggaaagattcatgtgtaacttagattgccaagaagagcctgacagctgtatctcagagaaactattcgaagagatggctgaacggatggtaaccgatggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgagtggggtgttgatttgttgaagtttgatggatgctactgcgattcgctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaaaacaaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 124 - protein, 398 aa, Artificial Sequence
  variant of human alpha-galactosidase A
LDNGLALTPPMGWLHWERFMCNLDCQEEPDSCISEKLFEEMAERMVTDGWKDAGYEYLCIDDCWMAPQRDSEGRLQADPQRFPHGIRQLANHVHSKGLKLGIYADVGNKTCAGFPGSFGYYDIDAQTFAEWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQNKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 125 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgatggatggaaggatgctggttatgaatacctatgtattgatgattgctggatggctccagagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 126 - protein, 398 aa, Artificial Sequence
  variant of human alpha-galactosidase A
LDNGLARTPPMGWLHWERFMCNLDCQEEPDSCISEKLFEEMAERMVTDGWKDAGYEYLCIDDCWMAPERDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 127 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagacaaggatgtcatagcgatcaaccaagatcctcttggtaaacaaggttatcaattgagaaaaggtgacgggtttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtgtctatgaagcaacctctaggctaagaagtcacattaatcctactggtacggtattgttgcaattggagaacacaatgcaaacctctttgaaagatttgttataa

SEQ ID NO: 128 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDGFEVWERPLSGDAWAVAIINRQEIGGPRSYTIPVASLGKGVACNPACFITQLLPVKRKLGVYEATSRLRSHINPTGTVLLQLENTMQTSLKDLL

SEQ ID NO: 129 - DNA, 1197 bp, Artificial Sequence
  variant of human alpha-galactosidase A
ttggataacgggttagccctgacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaaaacaaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 130 - protein, 398 aa, Artificial Sequence
  variant of human alpha-galactosidase A
LDNGLALTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQNKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 131 - DNA, 1197 bp, Artificial Sequence
  variant of human alpha-galactosidase A
ttggataacgggttagccctgacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccagagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgagtggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaaaacaaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtgtctatgaagcaacctctaggctaagaagtcacattaatcctactggtacggtattgttgcaattggagaacacaatgcaaacctctttgaaagatttgttataa

SEQ ID NO: 132 - protein, 398 aa, Artificial Sequence
  variant of human alpha-galactosidase A
LDNGLALTPPMGWLHWERFMCNLDCQEEPDSCISEKLFEEMAERMVTEGWKDAGYEYLCIDDCWMAPERDSEGRLQADPQRFPHGIRQLANHVHSKGLKLGIYADVGNKTCAGFPGSFGYYDIDAQTFAEWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQNKDVIAINQDPLGKQGYQLRKGDNFEVWERPLSGDAWAVAIINRQEIGGPRSYTIPVASLGKGVACNPACFITQLLPVKRKLGVYEATSRLRSHINPTGTVLLQLENTMQTSLKDLL

SEQ ID NO: 133 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgatggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaaaacaaggatgtcatagcgatcaaccaagatcctcttggtaaacaaggttatcaactgagaaaaggtgacaattttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 134 - protein, 398 aa, Artificial Sequence
  variant of human alpha-galactosidase A
LDNGLARTPPMGWLHWERFMCNLDCQEEPDSCISEKLFEEMAERMVTDGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQNKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 135 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatggtcgtcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaaaggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 136 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWSSIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 137 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaaccgtactggtaggccgatcgtctatagttgtgaatggcccttgtacatgtggccgtttcagaagccaaactacactgagataagacaatactgtaaccattggcgtaactttgctgacatagatgattcatgggcgtcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtgacggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 138 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGDGVACNPACFITQLLPVKRKLGFYEATSRLRSHINPTGTVLLQLENTMQTSLKDLL

SEQ ID NO: 139 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtggcggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 140 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGGGVACNPACFITQLLPVKRKLGFYEATSRLRSHINPTGTVLLQLENTMQTSLKDLL

SEQ ID NO: 141 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgccagcttgcaaatcatgtacacagtctgggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 142 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSLGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 143 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagtctgggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagacaattgtctggagacgcgtgggctgttgctattatcaaccgtcaagagatcggagggccaagatcttacactatcccggtagcctctttgggtggcggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 144 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSLGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERQLSGDAWAVAIINRQEIGGPRSYTIPVASLGGGVACNPACFITQLLPVKRKLGFYEATSRLRSHINPTGTVLLQLENTMQTSLKDLL

SEQ ID NO: 145 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaatcatgtacacagtctgggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcgtcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataccgccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaaaggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 146 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSLGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAIPPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 147 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtgcagctctaaacaaaactggtaggccgatcgtctatagttgtgaatggcccttgtacatgtggccgtttcagaagccaaactacactgagataagacaatactgtaaccattggcgtaactttgctgacatagatgattcatgggcgtcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataggcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaaaggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 148 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSAALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAIGPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 149 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtcgtgctctaaaccgtactggtaggccgatcgtctatagttgtgaatggcccttgtacatgtggccgtttcagaagccaaactacactgagataagacaatactgtaaccattggcgtaactttgctgacatagatgattcatgggcgtcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 150 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSRALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 151 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgccagcttgcacagcatgtacacgagaagggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcgtcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaaaggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 152 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLAQHVHEKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 153 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgccagcttgcacagcatgtacacgagctgggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcgtcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaaaggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 154 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLAQHVHELGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 155 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaaccatactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtgacggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 156 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNHTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGDGVACNPACFITQLLPVKRKLGFYEATSRLRSHINPTGTVLLQLENTMQTSLKDLL

SEQ ID NO: 157 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 158 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 159 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataccgccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaaaggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 160 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAIPPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 161 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacagtactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 162 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNSTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 163 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcataaagcagcttgcaaatcatgtacacagtattggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaaaacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcgtcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataccgccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtggcggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 164 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIKQLANHVHSIGLKLGIYADVGNKTCAGFPGSFGYYDIDAQTFADWGVDLLKFDGCYCDSLENLADGYKNMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAIPPQAKALLQDKDVIAINQDPLGKQGYQLRKGDNFEVWERPLSGDAWAVAIINRQEIGGPRSYTIPVASLGGGVACNPACFITQLLPVKRKLGFYEATSRLRSHINPTGTVLLQLENTMQTSLKDLL

SEQ ID NO: 165 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcataaagcagcttgcacagcatgtacacgagctgggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatggtcgtcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtggcggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 166 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIKQLAQHVHELGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWSSIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGGGVACNPACFITQLLPVKRKLGFYEATSRLRSHINPTGTVLLQLENTMQTSLKDLL

SEQ ID NO: 167 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcataaagcagcttgcacagcatgtacacgagctgggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtgcagctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 168 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIKQLAQHVHELGLKLGIYADVGNKTCAGFPGSFGYYDIDAQTFADWGVDLLKFDGCYCDSLENLADGYKHMSAALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 169 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcgtcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataccgccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 170 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAIPPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 171 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataccgccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtggcggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 172 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAIPPQAKALLQDKDVIAINQDPLGKQGYQLRKGDNFEVWERPLSGDAWAVAIINRQEIGGPRSYTIPVASLGGGVACNPACFITQLLPVKRKLGFYEATSRLRSHINPTGTVLLQLENTMQTSLKDLL

SEQ ID NO: 173 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtagacgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcgtcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaaaggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 174 - protein, 398 aa, Artificial Sequence
  variant of human alpha-galactosidase A
LDNGLARTPPMGWLHWERFMCNLDCQEEPDSCISEKLFEEMAERMVDEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 175 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtagacgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcgtcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtggcggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 176 - protein, 398 aa, Artificial Sequence
  variant of human alpha-galactosidase A
LDNGLARTPPMGWLHWERFMCNLDCQEEPDSCISEKLFEEMAERMVDEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGGGVACNPACFITQLLPVKRKLGFYEATSRLRSHINPTGTVLLQLENTMQTSLKDLL

SEQ ID NO: 177 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtagacgaaggatggaaggatgctggttatgaatacctatgtattgatgattgctggatggctccacagcgtgattcagaaggtaggttacaagctgacccccagagattcccacatggcataaagcagcttgcaaatcatgtacacgagctgggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtcgtgctctaaaccatactggtaggccgatcgtctatagttgtgaatggcccttgtacatgtggccgtttcagaagccaaactacactgagataagacaatactgtaaccattggcgtaactttgctgacatagatgattcatgggcgtcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 178 - protein, 398 aa, Artificial Sequence
  variant of human alpha-galactosidase A
LDNGLARTPPMGWLHWERFMCNLDCQEEPDSCISEKLFEEMAERMVDEGWKDAGYEYLCIDDCWMAPQRDSEGRLQADPQRFPHGIKQLANHVHELGLKLGIYADVGNKTCAGFPGSFGYYDIDAQTFADWGVDLLKFDGCYCDSLENLADGYKHMSRALNHTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 179 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtagacgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataccgccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 180 - protein, 398 aa, Artificial Sequence
  variant of human alpha-galactosidase A
LDNGLARTPPMGWLHWERFMCNLDCQEEPDSCISEKLFEEMAERMVDEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAIPPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 181 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtagacgaaggatggaaggatgctggttatgaatacctatgtattgatgattgctggatggctccacagcgtgattcagaaggtaggttacaagctgacccccagagattcccacatggcatacgccagcttgcaaatcatgtacacgagaagggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaaccgtactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaaaggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 182 - protein, 398 aa, Artificial Sequence
  variant of human alpha-galactosidase A
LDNGLARTPPMGWLHWERFMCNLDCQEEPDSCISEKLFEEMAERMVDEGWKDAGYEYLCIDDCWMAPQRDSEGRLQADPQRFPHGIRQLANHVHEKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 183 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatggggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 184 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMGPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 185 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacaagatgcaaacctctttgaaagatttgttataa

SEQ ID NO: 186 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENKMQTSLKDLL

SEQ ID NO: 187 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgacgcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 188 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPTQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 189 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtgcgtatgaagcaacctctaggctaagaagtcacattaatcctactggtacggtattgttgcaattggagaacacaatgcaaacctctttgaaagatttgttataa

SEQ ID NO: 190 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGAYEATSRLRSHINPTGTVLLQLENTMQTSLKDLL

SEQ ID NO: 191 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccggttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 192 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPVQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 193 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtgcggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 194 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSAALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 195 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgctgcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 196 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPLQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 197 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaaccggtaggctaagaagtcacattaatcctactggtacggtattgttgcaattggagaacacaatgcaaacctctttgaaagatttgttataa

SEQ ID NO: 198 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATGRLRSHINPTGTVLLQLENTMQTSLKDLL

SEQ ID NO: 199 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgtcttaa

SEQ ID NO: 200 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLS

SEQ ID NO: 201 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatgctttataa

SEQ ID NO: 202 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDAL

SEQ ID NO: 203 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatggaagtcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 204 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 205 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggaagatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 206 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRKIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 207 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtaggatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 208 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRRISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 209 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaaggtttaactcga

SEQ ID NO: 210 - protein, 399 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKGLTR

SEQ ID NO: 211 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgagtccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 212 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMSPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 213 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattggcgggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 214 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLAGDAWAVAIINRQEIGGPRSYTIPVASLGKGVACNPACFITQLLPVKRKLGFYEATSRLRSHINPTGTVLLQLENTMQTSLKDLL

SEQ ID NO: 215 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgatccggaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 216 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDPEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 217 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctaagaaagatttgttataa

SEQ ID NO: 218 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSKKDLL

SEQ ID NO: 219 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttgctaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 220 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFAKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 221 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgcggcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 222 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGAACNPACFITQLLPVKRKLGFYEATSRLRSHINPTGTVLLQLENTMQTSLKDLL

SEQ ID NO: 223 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatattcacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 224 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHIHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 225 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtcagtatgaagcaacctctaggctaagaagtcacattaatcctactggtacggtattgttgcaattggagaacacaatgcaaacctctttgaaagatttgttataa

SEQ ID NO: 226 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGQYEATSRLRSHINPTGTVLLQLENTMQTSLKDLL

SEQ ID NO: 227 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactgtgccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 228 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTVPVASLGKGVACNPACFITQLLPVKRKLGFYEATSRLRSHINPTGTVLLQLENTMQTSLKDLL

SEQ ID NO: 229 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaactttgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 230 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANFVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 231 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttggtgtaa

SEQ ID NO: 232 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLV

SEQ ID NO: 233 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgccgtaa

SEQ ID NO: 234 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLP

SEQ ID NO: 235 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgatgaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 236 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLMKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 237 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatccgggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 238 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIRVASLGKGVACNPACFITQLLPVKRKLGFYEATSRLRSHINPTGTVLLQLENTMQTSLKDLL

SEQ ID NO: 239 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagagggtacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 240 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRGYTIPVASLGKGVACNPACFITQLLPVKRKLGFYEATSRLRSHINPTGTVLLQLENTMQTSLKDLL

SEQ ID NO: 241 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaacagggtttctatgaagcaacctctaggctaagaagtcacattaatcctactggtacggtattgttgcaattggagaacacaatgcaaacctctttgaaagatttgttataa

SEQ ID NO: 242 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKQGFYEATSRLRSHINPTGTVLLQLENTMQTSLKDLL

SEQ ID NO: 243 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtagtggaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 244 - protein, 398 aa, Artificial Sequence
  variant of human alpha-galactosidase A
LDNGLARTPPMGWLHWERFMCNLDCQEEPDSCISEKLFEEMAERMVVEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 245 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaacacggtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 246 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANTVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 247 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaaccgttttgaaagatttgttataa

SEQ ID NO: 248 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTVLKDLL

SEQ ID NO: 249 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccctggggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 250 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLALGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 251 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcataggtaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagattttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 252 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRFYTIPVASLGKGVACNPACFITQLLPVKRKLGFYEATSRLRSHINPTGTVLLQLENTMQTSLKDLL

SEQ ID NO: 253 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcctggtaaacaaggttatcaattaagaaagggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatggctacctctttgaaagatttgttataa

SEQ ID NO: 254 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPPGKQGYQLRKGDNFEVWERPLSGDAWAVAIINRQEIGGPRSYTIPVASLGKGVACNPACFITQLLPVKRKLGFYEATSRLRSHINPTGTVLLQLENTMATSLKDLL

SEQ ID NO: 255 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtcaggcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 256 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGQACNPACFITQLLPVKRKLGFYEATSRLRSHINPTGTVLLQLENTMQTSLKDLL

SEQ ID NO: 257 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgtggagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 258 - protein, 398 aa, Artificial Sequence
  variant of human alpha-galactosidase A
LDNGLARTPPMGWLHWERFMCNLDCQEEPDSCISEKLFVEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 259 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctaagaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 260 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSKNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 261 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttggcttaa

SEQ ID NO: 262 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLA

SEQ ID NO: 263 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgacggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 264 - protein, 398 aa, Artificial Sequence
  variant of human alpha-galactosidase A
LDNGLARTPPMGWLHWERFMCNLDCQEEPDSCISEKLFEEMAERMVTDGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 265 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgacggatggaaggatgctggttatgaatacctatgtattgatgattgctggatggctccagagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 266 - protein, 398 aa, Artificial Sequence
  variant of human alpha-galactosidase A
LDNGLARTPPMGWLHWERFMCNLDCQEEPDSCISEKLFEEMAERMVTDGWKDAGYEYLCIDDCWMAPERDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 267 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgacggatggaaggatgctggttatgaatacctatgtattgatgattgctggatggctccagagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctaagaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagattctacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatggcgaccgtattgaaagatttgttataa

SEQ ID NO: 268 - protein, 398 aa, Artificial Sequence
  variant of human alpha-galactosidase A
LDNGLARTPPMGWLHWERFMCNLDCQEEPDSCISEKLFEEMAERMVTDGWKDAGYEYLCIDDCWMAPERDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSKNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRFYTIPVASLGKGVACNPACFITQLLPVKRKLGFYEATSRLRSHINPTGTVLLQLENTMATVLKDLL

SEQ ID NO: 269 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgacggatggaaggatgctggttatgaatacctatgtattgatgattgctggatggctccagagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctctgggtaaacaaggttatcaattgagaaaaggtgacaactttgaagtgtgggaaagaccattgtctggagacgcgtgggctgttgctattatcaaccgtcaagagatcggagggccaagattctacactatcccggtagcctctttgggtaagggtgttgcgtgcaatcctgcctgcttcattacacaattgcttccagttaagagaaaactgggtttctatgaagcaacctctaggctaagaagtcacattaatcctactggtacggtattgttgcaattggagaacacaatgcaaacctctttgaaagatttgttataa

SEQ ID NO: 270 - protein, 398 aa, Artificial Sequence
  variant of human alpha-galactosidase A
LDNGLARTPPMGWLHWERFMCNLDCQEEPDSCISEKLFEEMAERMVTDGWKDAGYEYLCIDDCWMAPERDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRFYTIPVASLGKGVACNPACFITQLLPVKRKLGFYEATSRLRSHINPTGTVLLQLENTMQTSLKDLL

SEQ ID NO: 271 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgacggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctaagaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagaagttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 272 - protein, 398 aa, Artificial Sequence
  variant of human alpha-galactosidase A
LDNGLARTPPMGWLHWERFMCNLDCQEEPDSCISEKLFEEMAERMVTDGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSKNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 273 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgacggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagattctacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 274 - protein, 398 aa, Artificial Sequence
  variant of human alpha-galactosidase A
LDNGLARTPPMGWLHWERFMCNLDCQEEPDSCISEKLFEEMAERMVTDGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRFYTIPVASLGKGVACNPACFITQLLPVKRKLGFYEATSRLRSHINPTGTVLLQLENTMQTSLKDLL

SEQ ID NO: 275 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgacggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagaggttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 276 - protein, 398 aa, Artificial Sequence
  variant of human alpha-galactosidase A
LDNGLARTPPMGWLHWERFMCNLDCQEEPDSCISEKLFEEMAERMVTDGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRGYTIPVASLGKGVACNPACFITQLLPVKRKLGFYEATSRLRSHINPTGTVLLQLENTMQTSLKDLL

SEQ ID NO: 277 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgacggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagaagttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcagaccgtattgaaagatttgttataa

SEQ ID NO: 278 - protein, 398 aa, Artificial Sequence
  variant of human alpha-galactosidase A
LDNGLARTPPMGWLHWERFMCNLDCQEEPDSCISEKLFEEMAERMVTDGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTVLKDLL

SEQ ID NO: 279 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgacggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtcaagcgtgcaatcctgcctgcttcattacacaattgcttccagttaagagaaaattgggtttctatgaagcaacctctaggctaagaagtcacattaatcctactggtacggtattgttgcaattggagaacacaatgcagaccgtattgaaagatttgttataa

SEQ ID NO: 280 - protein, 398 aa, Artificial Sequence
  variant of human alpha-galactosidase A
LDNGLARTPPMGWLHWERFMCNLDCQEEPDSCISEKLFEEMAERMVTDGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGQACNPACFITQLLPVKRKLGFYEATSRLRSHINPTGTVLLQLENTMQTVLKDLL

SEQ ID NO: 281 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccagagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 282 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPERDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 283 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccagagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtcaagcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 284 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPERDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGQACNPACFITQLLPVKRKLGFYEATSRLRSHINPTGTVLLQLENTMQTSLKDLL

SEQ ID NO: 285 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctaagaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagattctacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 286 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSKNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRFYTIPVASLGKGVACNPACFITQLLPVKRKLGFYEATSRLRSHINPTGTVLLQLENTMQTSLKDLL

SEQ ID NO: 287 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctaagaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagaggttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcagaccagcttgaaagatttgttataa

SEQ ID NO: 288 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSKNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRGYTIPVASLGKGVACNPACFITQLLPVKRKLGFYEATSRLRSHINPTGTVLLQLENTMQTSLKDLL

SEQ ID NO: 289 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagattctacactatcccggtagcctctttgggtaagggtcaagcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 290 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRFYTIPVASLGKGQACNPACFITQLLPVKRKLGFYEATSRLRSHINPTGTVLLQLENTMQTSLKDLL

SEQ ID NO: 291 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagaggttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 292 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRGYTIPVASLGKGVACNPACFITQLLPVKRKLGFYEATSRLRSHINPTGTVLLQLENTMQTSLKDLL

SEQ ID NO: 293 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgagtggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 294 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFAEWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 295 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaggagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccctggggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatggtcgtcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaaaacaaggatgtcatagcgatcaaccaagatcctcttggtaaacaaggttatcaattgcgtaaaggtgacaactttgaagtgtgggaaagaccattgtctggagacgcgtgggctgttgctattatcaaccgtcaagagatcggagggccaagatcttacactatccgtgtagcctctttgggtgatggtcaggcgtgcaatcctgcctgcttcattacacaattgcttccagttaagagaaaattgggtttctatgaagcaacctctaggctaagaagtcacattaatcctactggtacggtattgttgcaattggagaacacaatgcaaaccagcttgaaagatttggcgtaa

SEQ ID NO: 296 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLALGYKHMSLALNKTGRPIVYSCEWPLYMWPFQKPNYTEIRQYCNHWRNFADIDDSWSSIKSILDWTSRNQERIVDVAGPGGWNDPDMLVIGNFGLSWDQQVTQMALWAIMAGPLFMSNDLRAISPQAKALLQNKDVIAINQDPLGKQGYQLRKGDNFEVWERPLSGDAWAVAIINRQEIGGPRSYTIRVASLGDGQACNPACFITQLLPVKRKLGFYEATSRLRSHINPTGTVLLQLENTMQTSLKDLA

SEQ ID NO: 297 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaggagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgagtggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcgtcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatccctgtagcctctttgggtaagggtcaggcgtgcaatcctgcctgcttcattacacaattgcttccagttaagagaaaattgggtttctatgaagcaacctctaggctaagaagtcacattaatcctactggtacggtattgttgcaattggagaacacaatgcaaaccgtattgaaagatttgctgtaa

SEQ ID NO: 298 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFAEWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGQACNPACFITQLLPVKRKLGFYEATSRLRSHINPTGTVLLQLENTMQTVLKDLL

SEQ ID NO: 299 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgtggagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcgtcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatccgtgtagcctctttgggtggtggtgtcgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttggcgtaa

SEQ ID NO: 300 - protein, 398 aa, Artificial Sequence
  variant of human alpha-galactosidase A
LDNGLARTPPMGWLHWERFMCNLDCQEEPDSCISEKLFVEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIRVASLGGGVACNPACFITQLLPVKRKLGFYEATSRLRSHINPTGTVLLQLENTMQTSLKDLA

SEQ ID NO: 301 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtagttgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccctggggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgcgtaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 302 - protein, 398 aa, Artificial Sequence
  variant of human alpha-galactosidase A
LDNGLARTPPMGWLHWERFMCNLDCQEEPDSCISEKLFEEMAERMVVEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLALGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 303 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtagttgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgagtggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 304 - protein, 398 aa, Artificial Sequence
  variant of human alpha-galactosidase A
LDNGLARTPPMGWLHWERFMCNLDCQEEPDSCISEKLFEEMAERMVVEGWKDAGYEYLCIDDCWMAPQRDSEGRLQADPQRFPHGIRQLANHVHSKGLKLGIYADVGNKTCAGFPGSFGYYDIDAQTFAEWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 305 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtagttgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtgatggtcaggcgtgcaatcctgcctgcttcattacacaattgcttccagttaagagaaaattgggtttctatgaagcaacctctaggctaagaagtcacattaatcctactggtacggtattgttgcaattggagaacacaatgcaaaccgtattgaaagatttgctgtaa

SEQ ID NO: 306 - protein, 398 aa, Artificial Sequence
  variant of human alpha-galactosidase A
LDNGLARTPPMGWLHWERFMCNLDCQEEPDSCISEKLFEEMAERMVVEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGDGQACNPACFITQLLPVKRKLGFYEATSRLRSHINPTGTVLLQLENTMQTVLKDLL

SEQ ID NO: 307 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaggagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatggtcgtcaatcaaatctatcttggattggacttctaagaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgcgtaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 308 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWSSIKSILDWTSKNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 309 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatccgtgtagcctctttgggtggtggtcaggcgtgcaatcctgcctgcttcattacacaattgcttccagttaagagaaaattgggtttctatgaagcaacctctaggctaagaagtcacattaatcctactggtacggtattgttgcaattggagaacacaatgcaaaccagcttgaaagatttggcgtaa

SEQ ID NO: 310 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIRVASLGGGQACNPACFITQLLPVKRKLGFYEATSRLRSHINPTGTVLLQLENTMQTSLKDLA

SEQ ID NO: 311 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaaaacaaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaaccgtattgaaagatttgctgtaa

SEQ ID NO: 312 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQNKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTVLKDLL

SEQ ID NO: 313 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcgtcaatcaaatctatcttggattggacttctcgcaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtgatggtgtcgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 314 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGDGVACNPACFITQLLPVKRKLGFYEATSRLRSHINPTGTVLLQLENTMQTSLKDLL

SEQ ID NO: 315 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgcaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtgatggtcaggcgtgcaatcctgcctgcttcattacacaattgcttccagttaagagaaaattgggtttctatgaagcaacctctaggctaagaagtcacattaatcctactggtacggtattgttgcaattggagaacacaatgcaaaccgtattgaaagatttggcgtaa

SEQ ID NO: 316 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGDGQACNPACFITQLLPVKRKLGFYEATSRLRSHINPTGTVLLQLENTMQTVLKDLA

SEQ ID NO: 317 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgtggagatggctgaacggatggtagttgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctaagaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaaccagcttgaaagatttgctgtaa

SEQ ID NO: 318 - protein, 398 aa, Artificial Sequence
  variant of human alpha-galactosidase A
LDNGLARTPPMGWLHWERFMCNLDCQEEPDSCISEKLFVEMAERMVVEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSKNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 319 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatggtcgtcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgtcgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 320 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWSSIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 321 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatccctgtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaaccgtattgaaagatttggcgtaa

SEQ ID NO: 322 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTVLKDLA

SEQ ID NO: 323 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgtggagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaaaacaaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatccgtgtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttggcgtaa

SEQ ID NO: 324 - protein, 398 aa, Artificial Sequence
  variant of human alpha-galactosidase A
LDNGLARTPPMGWLHWERFMCNLDCQEEPDSCISEKLFVEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQNKDVIAINQDPLGKQGYQLRKGDNFEVWERPLSGDAWAVAIINRQEIGGPRSYTIRVASLGKGVACNPACFITQLLPVKRKLGFYEATSRLRSHINPTGTVLLQLENTMQTSLKDLA

SEQ ID NO: 325 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccctggggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagacaaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 326 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLALGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 327 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgcaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaaccgtattgaaagatttgctgtaa

SEQ ID NO: 328 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTVLKDLL

SEQ ID NO: 329 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaggagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctaagaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatccgtgtagcctctttgggtaagggtcaggcgtgcaatcctgcctgcttcattacacaattgcttccagttaagagaaaattgggtttctatgaagcaacctctaggctaagaagtcacattaatcctactggtacggtattgttgcaattggagaacacaatgcaaaccagcttgaaagatttggcgtaa

SEQ ID NO: 330 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSKNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIRVASLGKGQACNPACFITQLLPVKRKLGFYEATSRLRSHINPTGTVLLQLENTMQTSLKDLA

SEQ ID NO: 331 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccctggggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaaaacaaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaaccgtattgaaagatttgctgtaa

SEQ ID NO: 332 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLALGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQNKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTVLKDLL

SEQ ID NO: 333 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgtggagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagacaaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaaccgtattgaaagatttggcgtaa

SEQ ID NO: 334 - protein, 398 aa, Artificial Sequence
  variant of human alpha-galactosidase A
LDNGLARTPPMGWLHWERFMCNLDCQEEPDSCISEKLFVEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTVLKDLA

SEQ ID NO: 335 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtcgtgctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatccctgtagcctctttgggtaagggtgtcgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 336 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSRALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 337 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccctggggtacaaacacatgagtcgtgctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctaagaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagacaaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatccctgtagcctctttgggtggtggtcaggcgtgcaatcctgcctgcttcattacacaattgcttccagttaagagaaaattgggtttctatgaagcaacctctaggctaagaagtcacattaatcctactggtacggtattgttgcaattggagaacacaatgcaaaccgtattgaaagatttgctgtaa

SEQ ID NO: 338 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLALGYKHMSRALNKTGRPIVYSCEWPLYMWPFQKPNYTEIRQYCNHWRNFADIDDSWASIKSILDWTSKNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGGGQACNPACFITQLLPVKRKLGFYEATSRLRSHINPTGTVLLQLENTMQTVLKDLL

SEQ ID NO: 339 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaggagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgagtggggtgttgatttgttgaagtttgatggatgctactgcgattccctggagaacctagccgatgggtacaaacacatgagtcgtgctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgcaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 340 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFAEWGVDLLKFDGCYCDSLENLADGYKHMSRALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 341 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccctggggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaaccgtattgaaagatttgctgtaa

SEQ ID NO: 342 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLALGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTVLKDLL

SEQ ID NO: 343 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaggagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctaagaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 344 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSKNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 345 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgagtggggtgttgatttgttgaagtttgatggatgctactgcgattccctggagaacctagccgatgggtacaaacacatgagtcgtgctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgcaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaaccgtattgaaagatttgctgtaa

SEQ ID NO: 346 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFAEWGVDLLKFDGCYCDSLENLADGYKHMSRALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTVLKDLL

SEQ ID NO: 347 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgtggagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccctggggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 348 - protein, 398 aa, Artificial Sequence
  variant of human alpha-galactosidase A
LDNGLARTPPMGWLHWERFMCNLDCQEEPDSCISEKLFVEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLALGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 349 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccctggggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatccctgtagcctctttgggtaagggtcaggcgtgcaatcctgcctgcttcattacacaattgcttccagttaagagaaaattgggtttctatgaagcaacctctaggctaagaagtcacattaatcctactggtacggtattgttgcaattggagaacacaatgcaaaccgtattgaaagatttggcgtaa

SEQ ID NO: 350 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLALGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGQACNPACFITQLLPVKRKLGFYEATSRLRSHINPTGTVLLQLENTMQTVLKDLA

SEQ ID NO: 351 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgtggagatggctgaacggatggtagatgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 352 - protein, 398 aa, Artificial Sequence
  variant of human alpha-galactosidase A
LDNGLARTPPMGWLHWERFMCNLDCQEEPDSCISEKLFVEMAERMVDEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 353 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtcgtgctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaaccgtattgaaagatttgctgtaa

SEQ ID NO: 354 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSRALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTVLKDLL

SEQ ID NO: 355 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctagcgattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctacagcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagaagctacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 356 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLAIDDCWMAPQRDSEGRLQADPQRFPHGIRQLANHVHSKGLKLGIYADVGNKTCAGFPGSFGYYDIDAQTFADWGVDLLKFDGCYSDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 357 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtaatataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcagacctctttgaaagatttgttataa

SEQ ID NO: 358 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRNISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 359 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacataaatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcagacctctttgaaagatttgttataa

SEQ ID NO: 360 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADINDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 361 - DNA, 1197 bp, Artificial Sequence
  variant of human alpha-galactosidase A
ttggataacgggttagcccgtacacctccgatgggttggcttcactgggaaagattcatgtgtaacttatcgtgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacataaatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagatcttacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 362 - protein, 398 aa, Artificial Sequence
  variant of human alpha-galactosidase A
LDNGLARTPPMGWLHWERFMCNLSCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADINDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 363 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagaaactacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 364 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRNYTIPVASLGKGVACNPACFITQLLPVKRKLGFYEATSRLRSHINPTGTVLLQLENTMQTSLKDLL

SEQ ID NO: 365 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgcattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctacagcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagaaactacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 366 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYSDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRNYTIPVASLGKGVACNPACFITQLLPVKRKLGFYEATSRLRSHINPTGTVLLQLENTMQTSLKDLL

SEQ ID NO: 367 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctacagcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtaatataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagaagctacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattggagaacacaatgcaaacctctttgaaagatttgttataa

SEQ ID NO: 368 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYSDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRNISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 369 - DNA, 1197 bp, Artificial Sequence
  variant of human alpha-galactosidase A
ttggataacgggttagcccgtacacctccgatgggttggcttcactgggaaagattcatgtgtaacttagattgccaagaagagcctgacagctgtatctcagagaaactattcgaagagatggctgaacggatggtaactgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctacagcgattccctggagaacctagccgatgggtacaaacacatgagtctggctctaaacaaaactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgataagcccccaagcaaaggctttacttcaagataaggatgtcatagcgatcaaccaagatcctcttggtaaacaaggttatcaattgagaaaaggtgacaactttgaagtgtgggaaagaccattgtctggagacgcgtgggctgttgctattatcaaccgtcaagagatcggagggccaagaagctacactatcccggtagcctctttgggtaagggtgttgcgtgcaatcctgcctgcttcattacacaattgcttccagttaagagaaaattgggtttctatgaagcaacctctaggctaagaagtcacattaatcctactggtacggtattgttgcaattgaacaacacaatgcagacctctttgaaagatttgttataa

SEQ ID NO: 370 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYSDSLENLADGYKHMSLALNKTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLNNTMQTSLKDLL

SEQ ID NO: 371 - DNA, 1194 bp, Artificial Sequence
  variant of human alpha-galactosidase A
ctggacaatggattggcaaggacgcctaccatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 372 - protein, 398 aa, Artificial Sequence; identical to SEQ ID NO: 2
  variant of human alpha-galactosidase A

SEQ ID NO: 373 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttgaggaaatggccgaacgaatggtgactgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggagacgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 374 - protein, 398 aa, Artificial Sequence; identical to SEQ ID NO: 58
  variant of human alpha-galactosidase A

SEQ ID NO: 375 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatctaggaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcgatgcctgggctgtagctattataaaccggcaggagattggtggacctcgctcttataccatccccgttgcttccctgggtaaaggagtggcctgtaatcctgcctgcttcatcacacagctcctccctgtgaaaaggaagctagggttctatgaagctacttcaaggttaagaagtcacataaatcccacaggcactgttttgcttcagctagaaaatacaatgcagatgtcattaaaagacttactt

SEQ ID NO: 376 - protein, 398 aa, Artificial Sequence
  variant of human alpha-galactosidase A
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGDAWAVAIINRQEIGGPRSYTIPVASLGKGVACNPACFITQLLPVKRKLGFYEATSRLRSHINPTGTVLLQLENTMQMSLKDLL

SEQ ID NO: 377 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaagagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgagccatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgccgttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 378 - protein, 398 aa, Artificial Sequence
  variant of human alpha-galactosidase A
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRAISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 379 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcatggagatggcagagctgatggtctctgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgagccatcagccctcaagccaaagctctccttcaggataaggacgtaattgccatcaatcaggaccccttgggcaagcaagggtaccagcttagacagggagacaactttgaagtgtgggaacgacctctctcaggcgatgcctgggctgtagctattataaaccggcaggagattggtggacctcgctcttataccatcgccgttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 380 - protein, 398 aa, Artificial Sequence
  variant of human alpha-galactosidase A
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRAISPQAKALLQDKDVIAINQDPLGKQGYQLRQGDNFEVWERPLSGDAWAVAIINRQEIGGPRSYTIAVASLGKGVACNPACFITQLLPVKRKLGFYEWTSRLRSHINPTGTVLLQLENTMQMSLKDLL

SEQ ID NO: 381 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcatggagatggcagagctgatggtctctgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgagccatcagccctcaagccaaagctctccttcaggataaggacgtaattgccatcaatcaggaccccttgggcaagcaagggtaccagcttagaaagggagacaactttgaagtgtgggaacgacctctctcaggcttagcctgggctgtagctattataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 382 - protein, 398 aa, Artificial Sequence
  variant of human alpha-galactosidase A
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRAISPQAKALLQDKDVIAINQDPLGKQGYQLRKGDNFEVWERPLSGLAWAVAIINRQEIGGPRSYTIAVASLGKGVACNPACFITQLLPVKRKLGFYEWTSRLRSHINPTGTVLLQLENTMQMSLKDLL

SEQ ID NO: 383 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctgggccagtataaagagtatcttggactggacatctaggaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgagccatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagacctcattaaaagacttactt

SEQ ID NO: 384 - protein, 398 aa, Artificial Sequence
  variant of human alpha-galactosidase A
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWNQQVTQMALWAIMAAPLFMSNDLRAISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQTSLKDLL

SEQ ID NO: 385 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcatggagatggcagagcggatggtctctgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctgggccagtataaagagtatcttggactggacatctttcaaccaggagagaattgttgatgttgctggaccagggggttggaatgacccagatatgttagtgattggcaactttggcctcagctggaaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatccccgttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 386 - protein, 398 aa, Artificial Sequence
  variant of human alpha-galactosidase A
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIPVASLGKGVACNPACFITQLLPVKRKLGFYEWTSRLRSHINPTGTVLLQLENTMQMSLKDLL

SEQ ID NO: 387 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcatggagatggcagagcggatggtctctgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctgggaccagcaagtaactcagatggccctctgggctatcatggctggtcctttattcatgtctaatgacctccgacacatcagccctcaagccaaagctctccttcaggataaggacgtaattgccatcaatcaggaccccttgggcaagcaagggtaccagcttagaaagggagacaactttgaagtgtgggaacgacctctctcaggcgatgcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 388 - protein, 398 aa, Artificial Sequence
  variant of human alpha-galactosidase A
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAGPLFMSNDLRHISPQAKALLQDKDVIAINQDPLGKQGYQLRKGDNFEVWERPLSGDAWAVAMINRQEIGGPRSYTIAVASLGKGVACNPACFITQLLPVKRKLGFYEWTSRLRSHINPTGTVLLQLENTMQMSLKDLL

SEQ ID NO: 389 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcatggagatggcagagcggatggtctctgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatctttcaaccaggagagaattgttgatgttgctggaccagggggttggaatgacccagatatgttagtgattggcaactttggcctcagctgggaccagcaagtaactcagatggccctctgggctatcatggctggtcctttattcatgtctaatgacctccgacacatcagccctcaagccaaagctctccttcaggataaggacgtaattgccatcaatcaggaccccttgggcaagcaagggtaccagcttagaaagggagacaactttgaagtgtgggaacgacctctctcaggcgatgcctgggctgtagctattataaaccggcaggagattggtggacctcgctcttataccatcgccgttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 390 - protein, 398 aa, Artificial Sequence
  variant of human alpha-galactosidase A
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAGPLFMSNDLRHISPQAKALLQDKDVIAINQDPLGKQGYQLRKGDNFEVWERPLSGDAWAVAIINRQEIGGPRSYTIAVASLGKGVACNPACFITQLLPVKRKLGFYEWTSRLRSHINPTGTVLLQLENTMQMSLKDLL

SEQ ID NO: 391 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcatggagatggcagagcggatggtcactgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctgggccagtataaagagtatcttggactggacatctaggaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgagccatcagccctcaagccaaagctctccttcaggataaggacgtaattgccatcaatcaggaccccttgggcaagcaagggtaccagcttagacagggagacaactttgaagtgtgggaacgacctctctcaggcctcgcctgggctgtagctattataaaccggcaggagattggtggacctcgctcttataccatcgccgttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 392 - protein, 398 aa, Artificial Sequence
  variant of human alpha-galactosidase A
LDNGLARTPTMGWLHWERFMCNLDCQEEPDSCISEKLFMEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRQGDNFEVWERPLSGLAWAVAIINRQEIGGPRSYTIAVASLGKGVACNPACFITQLLPVKRKLGFYEWTSRLRSHINPTGTVLLQLENTMQMSLKDLL

SEQ ID NO: 393 - DNA, 1194 bp, Artificial Sequence
  variant of human alpha-galactosidase A
ctggacaatggattggcaaggacgcctaccatgggctggctgcactgggagcgcttcatgtgcaaccttgactgccaggaagagccagattcctgcatcagtgagaagctcttcatggagatggcagagcggatggtcactgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcctcgcctgggctgtagctattataaaccggcaggagattggtggacctcgctcttataccatcgcagttgcttccctgggtaaaggagtggcctgtaatcctgcctgcttcatcacacagctcctccctgtgaaaaggaagctagggttctatgaagctacttcaaggttaagaagtcacataaatcccacaggcactgttttgcttcagctagaaaatacaatgcagatgtcattaaaagacttactt

SEQ ID NO: 394 - protein, 398 aa, Artificial Sequence
  variant of human alpha-galactosidase A
LDNGLARTPTMGWLHWERFMCNLDCQEEPDSCISEKLFMEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAIINRQEIGGPRSYTIAVASLGKGVACNPACFITQLLPVKRKLGFYEATSRLRSHINPTGTVLLQLENTMQMSLKDLL

SEQ ID NO: 395 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcatggagatggcagagcggatggtcactgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatctttcaaccaggagagaattgttgatgttgctggaccagggggttggaatgacccagatatgttagtgattggcaactttggcctcagctggaaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagaaagggagacaactttgaagtgtgggaacgacctctctcaggcgatgcctgggctgtagctattataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 396 - protein, 398 aa, Artificial Sequence
  variant of human alpha-galactosidase A
LDNGLARTPTMGWLHWERFMCNLDCQEEPDSCISEKLFMEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGDAWAVAIINRQEIGGPRSYTIAVASLGKGVACNPACFITQLLPVKRKLGFYEWTSRLRSHINPTGTVLLQLENTMQMSLKDLL

SEQ ID NO: 397 - DNA, 1251 bp, Artificial Sequence
  variant of human alpha-galactosidase A
atggaatggagctgggtctttctcttcttcctgtcagtaacgactggtgtccactccctggacaatggattggcaaggacgcctacaatgggctggctgcactgggagcgcttcatgtgcaaccttgactgccaggaagagccagattcctgcatcagtgagaagctcttcatggagatggcagagcggatggtcactgaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctgggccagtataaagagtatcttggactggacatctaggaaccaggagagaattgttgatgttgctggaccagggggttggaatgacccagatatgttagtgattggcaactttggcctcagctggaaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcgatgcctgggctgtagctattataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 398 - protein, 417 aa, Artificial Sequence
  variant of human alpha-galactosidase A
MEWSWVFLFFLSVTTGVHSLDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGDAWAVAIINRQEIGGPRSYTIAVASLGKGVACNPACFITQLLPVKRKLGFYEWTSRLRSHINPTGTVLLQLENTMQMSLKDLL

SEQ ID NO: 399 - DNA, 1251 bp, Artificial Sequence
  variant of human alpha-galactosidase A
atggaatggagctgggtctttctcttcttcctgtcagtaacgactggtgtccactccctggacaatggattggcaaggacgcctacaatgggctggctgcactgggagcgcttcatgtgcaaccttgactgccaggaagagccagattcctgcatcagtgagaagctcttcatggagatggcagagcggatggtcactgaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctgggaccagcaagtaactcagatggccctctgggctatcatggctggtcctttattcatgtctaatgacctccgagccatcagccctcaagccaaagctctccttcaggataaggacgtaattgccatcaatcaggaccccttgggcaagcaagggtaccagcttagacagggagacaactttgaagtgtgggaacgacctctctcaggcgatgcctgggctgtagctatgataaaccggcaggagattggtggacctcgctcttataccatccccgttgcttccctgggtaaaggagtggcctgtaatcctgcctgcttcatcacacagctcctccctgtgaaaaggaagctagggttctatgaagctacttcaaggttaagaagtcacataaatcccacaggcactgttttgcttcagctagaaaatacaatgcagatgtcattaaaagacttactt

SEQ ID NO: 400 - protein, 417 aa, Artificial Sequence
  variant of human alpha-galactosidase A
MEWSWVFLFFLSVTTGVHSLDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAGPLFMSNDLRAISPQAKALLQDKDVIAINQDPLGKQGYQLRQGDNFEVWERPLSGDAWAVAMINRQEIGGPRSYTIPVASLGKGVACNPACFITQLLPVKRKLGFYEATSRLRSHINPTGTVLLQLENTMQMSLKDLL

SEQ ID NO: 401 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcatggagatggcagagcggatggtctctgaaggctggaaggatgcaggttatgagtacctatgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctgggccagtataaagagtatcttggactggacatctttcaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgccgttgcttccctgggtaaaggagtggcctgtaatcctgcctgcttcatcacacagctcctccctgtgaaaaggaagctagggttctatgaagctacttcaaggttaagaagtcacataaatcccacaggcactgttttgcttcagctagaaaatacaatgcagatgtcattaaaagacttactt

SEQ ID NO: 402 - protein, 398 aa, Artificial Sequence
  variant of human alpha-galactosidase A
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEATSRLRSHINPTGTVLLQLENTMQMSLKDLL

SEQ ID NO: 403 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcatggagatggcagagctgatggtctctgaaggctggaaggatgcaggttatgagtacctctgcattgatgactgttggatggctccccaaagagattcagaaggcagacttcaggcagaccctcagcgctttcctcatgggattcgccagatagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaagagtataaagagtatcttggactggacatctaggaaccaggagagaattgttgatgttgctggaccagggggttggaatgacccagatatgttagtgattggcaactttggcctcagctgggaccagcaagtaactcagatggccctctgggctatcatggctggtcctttattcatgtctaatgacctccgacacatcagccctcaagccaaagctctccttcaggataaggacgtaattgccatcaatcaggaccccttgggcaagcaagggtaccagcttagaaagggagacaactttgaagtgtgggaacgacctctctcaggcgatgcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 404 - protein, 398 aa, Artificial Sequence
  variant of human alpha-galactosidase A
LDNGLARTPTMGWLHWERFMCNLDCQEEPDSCISEKLFMEMAELMVSEGWKDAGYEYLCIDDCWMAPQRDSEGRLQADPQRFPHGIRQIANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAGPLFMSNDLRHISPQAKALLQDKDVIAINQDPLGKQGYQLRKGDNFEVWERPLSGDAWAVAMINRQEIGGPRSYTIAVASLGKGVACNPACFITQLLPVKRKLGFYEWTSRLRSHINPTGTVLLQLENTMQMSLKDLL

SEQ ID NO: 405 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcgaggagatggcagagcggatggtctctgaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaagagtataaagagtatcttggactggacatctaggaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcctcgcctgggctgtagctattataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 406 - protein, 398 aa, Artificial Sequence
  variant of human alpha-galactosidase A
LDNGLARTPTMGWLHWERFMCNLDCQEEPDSCISEKLFEEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAIINRQEIGGPRSYTIAVASLGKGVACNPACFITQLLPVKRKLGFYEWTSRLRSHINPTGTVLLQLENTMQMSLKDLL

SEQ ID NO: 407 - DNA, 1194 bp, Artificial Sequence
  variant of human alpha-galactosidase A
ctggacaatggattggcaaggacgcctaccatgggctggctgcactgggagcgcttcatgtgcaaccttgactgccaggaagagccagattcctgcatcagtgagaagctcttcgaggagatggcagagcggatggtctctgaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgagccatcagccctcaagccaaagctctccttcaggataaggacgtaattgccatcaatcaggaccccttgggcaagcaagggtaccagcttagaaagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 408 - protein, 398 aa, Artificial Sequence
  variant of human alpha-galactosidase A
LDNGLARTPTMGWLHWERFMCNLDCQEEPDSCISEKLFEEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 409 - DNA, 1251 bp, Artificial Sequence
  variant of human alpha-galactosidase A
atggaatggagctgggtctttctcttcttcctgtcagtaacgactggtgtccactccctggacaatggattggcaaggacgcctacaatgggctggctgcactgggagcgcttcatgtgcaaccttgactgccaggaagagccagattcctgcatcagtgagaagctcttcgaggagatggcagagcggatggtctctgaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaatatgactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatctttcaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagaaagggagacaactttgaagtgtgggaacgacctctctcaggcgatgcctgggctgtagctattataaaccggcaggagattggtggacctcgctcttataccatcgccgttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 410 - protein, 417 aa, Artificial Sequence
  variant of human alpha-galactosidase A
MEWSWVFLFFLSVTTGVHSLDNGLARTPTMGWLHWERFMCNLDCQEEPDSCISEKLFEEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNMTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIAVASLGKGVACNPACFITQLLPVKRKLGFYEWTSRLRSHINPTGTVLLQLENTMQMSLKDLL

SEQ ID NO: 411 - DNA, 1251 bp, Artificial Sequence
  variant of human alpha-galactosidase A
atggaatggagctgggtctttctcttcttcctgtcagtaacgactggtgtccactccctggacaatggattggcaaggacgcctacaatgggctggctgcactgggagcgcttcatgtgcaaccttgactgccaggaagagccagattcctgcatcagtgagaagctcttcgaggagatggcagagctgatggtctctgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaagagtataaagagtatcttggactggacatcttttaaccaggagagaattgttgatgttgctggaccagggggttggaatgacccagatatgttagtgattggcaactttggcctcagctggaaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcctcgcctgggctgtagctattataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 412 - protein, 417 aa, Artificial Sequence
  variant of human alpha-galactosidase A
MEWSWVFLFFLSVTTGVHSLDNGLARTPTMGWLHWERFMCNLDCQEEPDSCISEKLFEEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAIINRQEIGGPRSYTIAVASLGKGVACNPACFITQLLPVKRKLGFYEWTSRLRSHINPTGTVLLQLENTMQMSLKDLL

SEQ ID NO: 413 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcgaggagatggcagagctgatggtctctgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgagccatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 414 - protein, 398 aa, Artificial Sequence
  variant of human alpha-galactosidase A
LDNGLARTPTMGWLHWERFMCNLDCQEEPDSCISEKLFEEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRAISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 415 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcgaggagatggcagagctgatggtctctgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgagccatcagccctcaagccaaagctctccttcaggataaggacgtaattgccatcaatcaggaccccttgggcaagcaagggtaccagcttagacagggagacaactttgaagtgtgggaacgacctctttcaggcgatgcctgggctgtagctatgataaaccggcaggagattggtggacctcgctcttataccatcgccgttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 416 - protein, 398 aa, Artificial Sequence
  variant of human alpha-galactosidase A
LDNGLARTPTMGWLHWERFMCNLDCQEEPDSCISEKLFEEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRAISPQAKALLQDKDVIAINQDPLGKQGYQLRQGDNFEVWERPLSGDAWAVAMINRQEIGGPRSYTIAVASLGKGVACNPACFITQLLPVKRKLGFYEWTSRLRSHINPTGTVLLQLENTMQMSLKDLL

SEQ ID NO: 417 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcgaggagatggcagagctgatggtcactgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatctaggaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgccgttgcttccctgggtaaaggagtggcctgtaatcctgcctgcttcatcacacagctcctccctgtgaaaaggaagctagggttctatgaagctacttcaaggttaagaagtcacataaatcccacaggcactgttttgcttcagctagaaaatacaatgcagatgtcattaaaagacttactt

SEQ ID NO: 418 - protein, 398 aa, Artificial Sequence
  variant of human alpha-galactosidase A
LDNGLARTPTMGWLHWERFMCNLDCQEEPDSCISEKLFEEMAELMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEATSRLRSHINPTGTVLLQLENTMQMSLKDLL

SEQ ID NO: 419 - DNA, 1251 bp, Artificial Sequence
  variant of human alpha-galactosidase A
atggaatggagctgggtctttctcttcttcctgtcagtaacgactggtgtccactccctggacaatggattggcaaggacgcctacaatgggctggctgcactgggagcgcttcatgtgcaaccttgactgccaggaagagccagattcctgcatcagtgagaagctcttcgaggagatggcagagctgatggtcactgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatctttcaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcctcgcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 420 - protein, 417 aa, Artificial Sequence
  variant of human alpha-galactosidase A
MEWSWVFLFFLSVTTGVHSLDNGLARTPTMGWLHWERFMCNLDCQEEPDSCISEKLFEEMAELMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 421 - DNA, 1194 bp, Artificial Sequence
  variant of human alpha-galactosidase A
ctggacaatggattggcaaggacgcctaccatgggctggctgcactgggagcgcttcatgtgcaaccttgactgccaggaagagccagattcctgcatcagtgagaagctcttcgaggagatggcagagctgatggtcactgaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatctttcaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagaaagggagacaactttgaagtgtgggaacgacctctctcaggcgatgcctgggctgtagctattataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 422 - protein, 398 aa, Artificial Sequence
  variant of human alpha-galactosidase A
LDNGLARTPTMGWLHWERFMCNLDCQEEPDSCISEKLFEEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIAVASLGKGVACNPACFITQLLPVKRKLGFYEWTSRLRSHINPTGTVLLQLENTMQMSLKDLL

SEQ ID NO: 423 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcgaggagatggcagagctgatggtctctgaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatctttcaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcgatgcctgggctgtagctattataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 424 - protein, 398 aa, Artificial Sequence
  variant of human alpha-galactosidase A
LDNGLARTPTMGWLHWERFMCNLDCQEEPDSCISEKLFEEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGDAWAVAIINRQEIGGPRSYTIAVASLGKGVACNPACFITQLLPVKRKLGFYEWTSRLRSHINPTGTVLLQLENTMQMSLKDLL

SEQ ID NO: 425 - DNA, 1194 bp, Artificial Sequence
  variant of human alpha-galactosidase A
ctggacaatggattggcaaggacgcctaccatgggctggctgcactgggagcgcttcatgtgcaaccttgactgccaggaagagccagattcctgcatcagtgagaagctcttcgaggagatggcagagctgatggtctctgaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagaaagggagacaactttgaagtgtgggaacgacctctctcaggcgatgcctgggctgtagctatgataaaccggcaggagattggtggacctcgctcttataccatccccgttgcttccctgggtaaaggagtggcctgtaatcctgcctgcttcatcacacagctcctccctgtgaaaaggaagctagggttctatgaagctacttcaaggttaagaagtcacataaatcccacaggcactgttttgcttcagctagaaaatacaatgcagatgtcattaaaagacttactt

SEQ ID NO: 426 - protein, 398 aa, Artificial Sequence
  variant of human alpha-galactosidase A
LDNGLARTPTMGWLHWERFMCNLDCQEEPDSCISEKLFEEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAMINRQEIGGPRSYTIPVASLGKGVACNPACFITQLLPVKRKLGFYEATSRLRSHINPTGTVLLQLENTMQMSLKDLL

SEQ ID NO: 427 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 428 - protein, 398 aa, Artificial Sequence
  variant of human alpha-galactosidase A
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 429 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttgaagaaatggccgaactgatggtgaccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccattattaatcggcaagagatcggaggtccacgctcctatacaattgctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagacttcactgaaggacctcctg

SEQ ID NO: 430 - protein, 398 aa, Artificial Sequence
  variant of human alpha-galactosidase A
LDNGLARTPPMGWLHWERFMCNLDCQEEPDSCISEKLFEEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIAVASLGKGVACNPACFITQLLPVKRKLGFYEATSRLRSHINPTGTVLLQLENTMQTSLKDLL

SEQ ID NO: 431 - DNA, 1194 bp, Artificial Sequence
  variant of human alpha-galactosidase A
ctggataatggattggctagaacacctcccatggggtggcttcactgggagaggttcatgtgcaacctggactgtcaggaagaaccagacagctgcatctccgagaagctctttgaagaaatggccgaactgatggtgtccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagttttaatcaggagcgaattgtggatgtcgcaggccctggaggatggaacgatccagacatgctggtgatcggcaattttggcctctcttgggaccagcaggttacccaaatggctctgtgggcaattatggccggccctcttttcatgagcaacgatctgcgcgctatctcaccacaggcaaaggccctgctccaagacaaagatgtgatagccatcaatcaggacccgttgggaaagcagggctaccagctgagaaagggcgacaactttgaggtctgggaaaggcctttgagtggactcgcgtgggctgtggccatgattaatcggcaagagatcggaggtccacgctcctatacaattcctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagatgtcactgaaggacctcctg

SEQ ID NO: 432 - protein, 398 aa, Artificial Sequence
  variant of human alpha-galactosidase A
LDNGLARTPPMGWLHWERFMCNLDCQEEPDSCISEKLFEEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSFNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGLAWAVAMINRQEIGGPRSYTIPVASLGKGVACNPACFITQLLPVKRKLGFYEATSRLRSHINPTGTVLLQLENTMQMSLKDLL

SEQ ID NO: 433 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgagccatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgccgttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 434 - protein, 398 aa, Artificial Sequence
  variant of human alpha-galactosidase A
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRAISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 435 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatctttcaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagaaagggagacaactttgaagtgtgggaacgacctctctcaggcctcgcctgggctgtagctatgataaaccggcaggagattggtggacctcgctcttataccatcgccgttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 436 - protein, 398 aa, Artificial Sequence
  variant of human alpha-galactosidase A
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 437 - DNA, 1251 bp, Artificial Sequence
  variant of human alpha-galactosidase A
atggaatggagctgggtctttctcttcttcctgtcagtaacgactggtgtccactccctggacaatggattggcaaggacgcctacaatgggctggctgcactgggagcgcttcatgtgcaaccttgactgccaggaagagccagattcctgcatcagtgagaagctcttcatggagatggcagagctgatggtctctgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatctttcaaccaggagagaattgttgatgttgctggaccagggggttggaatgacccagatatgttagtgattggcaactttggcctcagctggaaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagaaagggagacaactttgaagtgtgggaacgacctctctcaggcttagcctgggctgtagctattataaaccggcaggagattggtggacctcgctcttataccatcgcagttgcttccctgggtaaaggagtggcctgtaatcctgcctgcttcatcacacagctcctccctgtgaaaaggaagctagggttctatgaagctacttcaaggttaagaagtcacataaatcccacaggcactgttttgcttcagctagaaaatacaatgcagatgtcattaaaagacttactt

SEQ ID NO: 438 - protein, 417 aa, Artificial Sequence
  variant of human alpha-galactosidase A
MEWSWVFLFFLSVTTGVHSLDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAIINRQEIGGPRSYTIAVASLGKGVACNPACFITQLLPVKRKLGFYEATSRLRSHINPTGTVLLQLENTMQMSLKDLL

SEQ ID NO: 439 - DNA, 1251 bp, Artificial Sequence
  variant of human alpha-galactosidase A
atggaatggagctgggtctttctcttcttcctgtcagtaacgactggtgtccactccctggacaatggattggcaaggacgcctacaatgggctggctgcactgggagcgcttcatgtgcaaccttgactgccaggaagagccagattcctgcatcagtgagaagctcttcatggagatggcagagctgatggtcactgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatctaggaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagaaagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 440 - protein, 417 aa, Artificial Sequence
  variant of human alpha-galactosidase A
MEWSWVFLFFLSVTTGVHSLDNGLARTPTMGWLHWERFMCNLDCQEEPDSCISEKLFMEMAELMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 441 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcatggagatggcagagctgatggtcactgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatctttcaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 442 - protein, 398 aa, Artificial Sequence
  variant of human alpha-galactosidase A
LDNGLARTPTMGWLHWERFMCNLDCQEEPDSCISEKLFMEMAELMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 443 - DNA, 1251 bp, Artificial Sequence
  variant of human alpha-galactosidase A
atggaatggagctgggtctttctcttcttcctgtcagtaacgactggtgtccactccctggacaatggattggcaaggacgcctacaatgggctggctgcactgggagcgcttcatgtgcaaccttgactgccaggaagagccagattcctgcatcagtgagaagctcttcatggagatggcagagctgatggtcactgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatctttcaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgagccatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 444 - protein, 417 aa, Artificial Sequence
  variant of human alpha-galactosidase A
MEWSWVFLFFLSVTTGVHSLDNGLARTPTMGWLHWERFMCNLDCQEEPDSCISEKLFMEMAELMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRAISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 445 - DNA, 1194 bp, Artificial Sequence
  variant of human alpha-galactosidase A
ctggacaatggattggcaaggacgcctaccatgggctggctgcactgggagcgcttcatgtgcaaccttgactgccaggaagagccagattcctgcatcagtgagaagctcttcatggagatggcagagctgatggtcactgaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatctttcaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgagccatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgccgttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 446 - protein, 398 aa, Artificial Sequence
  variant of human alpha-galactosidase A
LDNGLARTPTMGWLHWERFMCNLDCQEEPDSCISEKLFMEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRAISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 447 - DNA, 1194 bp, Artificial Sequence
  variant of human alpha-galactosidase A
ctggacaatggattggcaaggacgcctccaatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 448 - protein, 398 aa, Artificial Sequence
  variant of human alpha-galactosidase A
LDNGLARTPPMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 449 - DNA, 1194 bp, Artificial Sequence
  variant of human alpha-galactosidase A
ctggacaatggattggcaaggacgcctccaatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaaccagcaagtaactcagatggccctctgggctatcatggctggtcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 450 - protein, 398 aa, Artificial Sequence
  variant of human alpha-galactosidase A
LDNGLARTPPMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAGPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 451 - DNA, 1194 bp, Artificial Sequence
  variant of human alpha-galactosidase A
ctggacaatggattggcaaggacgcctccaatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaagagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatccccgttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagacctcattaaaagacttactt

SEQ ID NO: 452 - protein, 398 aa, Artificial Sequence
  variant of human alpha-galactosidase A
LDNGLARTPPMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIPVASLGKGVACNPACFITQLLPVKRKLGFYEWTSRLRSHINPTGTVLLQLENTMQTSLKDLL

SEQ ID NO: 453 - DNA, 1194 bp, Artificial Sequence
  variant of human alpha-galactosidase A
ctggacaatggattggcaaggacgcctccaatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgagccatcagccctcaagccaaagctctccttcaggataaggacgtaattgccatcaatcaggaccccttgggcaagcaagggtaccagcttagaaagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 454 - protein, 398 aa, Artificial Sequence
  variant of human alpha-galactosidase A
LDNGLARTPPMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRAISPQAKALLQDKDVIAINQDPLGKQGYQLRKGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 455 - DNA, 1194 bp, Artificial Sequence
  variant of human alpha-galactosidase A
ctggacaatggattggcaaggacgcctccaatgggctggctgcactgggagcgcttcatgtgcaaccttgactgccaggaagagccagattcctgcatcagtgagaagctcttcatggagatggcagagctgatggtctctgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctgggccagtataaagagtatcttggactggacatctttcaaccaggagagaattgttgatgttgctggaccagggggttggaatgacccagatatgttagtgattggcaactttggcctcagctggaaccagcaagtaactcagatggccctctgggctatcatggctggtcctttattcatgtctaatgacctccgagccatcagccctcaagccaaagctctccttcaggataaggacgtaattgccatcaatcaggaccccttgggcaagcaagggtaccagcttagacagggagacaactttgaagtgtgggaacgacctctctcaggcgatgcctgggctgtagctatgataaaccggcaggagattggtggacctcgctcttataccatcgccgttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 456 - protein, 398 aa, Artificial Sequence
  variant of human alpha-galactosidase A
LDNGLARTPPMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAGPLFMSNDLRAISPQAKALLQDKDVIAINQDPLGKQGYQLRQGDNFEVWERPLSGDAWAVAMINRQEIGGPRSYTIAVASLGKGVACNPACFITQLLPVKRKLGFYEWTSRLRSHINPTGTVLLQLENTMQMSLKDLL

SEQ ID NO: 457 - DNA, 1194 bp, Artificial Sequence
  variant of human alpha-galactosidase A
ctggacaatggattggcaaggacgcctccaatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctgggccagtataaagagtatcttggactggacatctaggaaccaggagagaattgttgatgttgctggaccagggggttggaatgacccagatatgttagtgattggcaactttggcctcagctggaaccagcaagtaactcagatggccctctgggctatcatggctgctcctttattcatgtctaatgacctccgagccatcagccctcaagccaaagctctccttcaggataaggacgtaattgccatcaatcaggaccccttgggcaagcaagggtaccagcttagacagggagacaactttgaagtgtgggaacgacctctctcaggcctcgcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 458 - protein, 398 aa, Artificial Sequence
  variant of human alpha-galactosidase A
LDNGLARTPPMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWNQQVTQMALWAIMAAPLFMSNDLRAISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 459 - DNA, 1251 bp, Artificial Sequence
  variant of human alpha-galactosidase A
atggaatggagctgggtctttctcttcttcctgtcagtaacgactggtgtccactccctggacaatggattggcaaggacgcctccaatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctgggccagtataaagagtatcttggactggacatcttttaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 460 - protein, 417 aa, Artificial Sequence
  variant of human alpha-galactosidase A
MEWSWVFLFFLSVTTGVHSLDNGLARTPPMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 461 - DNA, 1194 bp, Artificial Sequence
  variant of human alpha-galactosidase A
ctggacaatggattggcaaggacgcctccaatgggctggctgcactgggagcgcttcatgtgcaaccttgactgccaggaagagccagattcctgcatcagtgagaagctcttcatggagatggcagagctgatggtctctgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatctttcaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcgatgcctgggctgtagctattataaaccggcaggagattggtggacctcgctcttataccatcgcagttgcttccctgggtaaaggagtggcctgtaatcctgcctgcttcatcacacagctactccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 462 - protein, 398 aa, Artificial Sequence
  variant of human alpha-galactosidase A
LDNGLARTPPMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGDAWAVAIINRQEIGGPRSYTIAVASLGKGVACNPACFITQLLPVKRKLGFYEWTSRLRSHINPTGTVLLQLENTMQMSLKDLL

SEQ ID NO: 463 - DNA, 1194 bp, Artificial Sequence
  variant of human alpha-galactosidase A
ctggacaatggattggcaaggacgcctccaatgggctggctgcactgggagcgcttcatgtgcaaccttgactgccaggaagagccagattcctgcatcagtgagaagctcttcatggagatggcagagcggatggtctctgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 464 - protein, 398 aa, Artificial Sequence
  variant of human alpha-galactosidase A
LDNGLARTPPMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 465 - DNA, 1194 bp, Artificial Sequence
  variant of human alpha-galactosidase A
ctggacaatggattggcaaggacgcctccaatgggctggctgcactgggagcgcttcatgtgcaaccttgactgccaggaagagccagattcctgcatcagtgagaagctcttcatggagatggcagagcggatggtctctgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaagagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctggtcctttattcatgtctaatgacctccgacacatcagccctcaagccaaagctctccttcaggataaggacgtaattgccatcaatcaggaccccttgggcaagcaagggtaccagcttagaaagggagacaactttgaagtgtgggaacgacctctctcaggcgatgcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 466 - protein, 398 aa, Artificial Sequence
  variant of human alpha-galactosidase A
LDNGLARTPPMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAGPLFMSNDLRHISPQAKALLQDKDVIAINQDPLGKQGYQLRKGDNFEVWERPLSGDAWAVAMINRQEIGGPRSYTIAVASLGKGVACNPACFITQLLPVKRKLGFYEWTSRLRSHINPTGTVLLQLENTMQMSLKDLL

SEQ ID NO: 467 - DNA, 1251 bp, Artificial Sequence
  variant of human alpha-galactosidase A
atggaatggagctgggtctttctcttcttcctgtcagtaacgactggtgtccactccctggacaatggattggcaaggacgcctccaatgggctggctgcactgggagcgcttcatgtgcaaccttgactgccaggaagagccagattcctgcatcagtgagaagctcttcatggagatggcagagcggatggtctctgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatctttcaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagaaagggagacaactttgaagtgtgggaacgacctctctcaggcttagcctgggctgtagctatgataaaccggcaggagattggtggacctcgctcttataccatccccgttgcttccctgggtaaaggagtggcctgtaatcctgcctgcttcatcacacagctcctccctgtgaaaaggaagctagggttctatgaagctacttcaaggttaagaagtcacataaatcccacaggcactgttttgcttcagctagaaaatacaatgcagatgtcattaaaagacttactt

SEQ ID NO: 468 - protein, 417 aa, Artificial Sequence
  variant of human alpha-galactosidase A
MEWSWVFLFFLSVTTGVHSLDNGLARTPPMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAMINRQEIGGPRSYTIPVASLGKGVACNPACFITQLLPVKRKLGFYEATSRLRSHINPTGTVLLQLENTMQMSLKDLL

SEQ ID NO: 469 - DNA, 1251 bp, Artificial Sequence
  variant of human alpha-galactosidase A
atggaatggagctgggtctttctcttcttcctgtcagtaacgactggtgtccactccctggacaatggattggcaaggacgcctccaatgggctggctgcactgggagcgcttcatgtgcaaccttgactgccaggaagagccagattcctgcatcagtgagaagctcttcatggagatggcagagcggatggtcactgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaaccagcaagtaactcagatggccctctgggctatcatggctggtcctttattcatgtctaatgacctccgacacatcagccctcaagccaaagctctccttcaggataaggacgtaattgccatcaatcaggaccccttgggcaagcaagggtaccagcttagaaagggagacaactttgaagtgtgggaacgacctctctcaggcctcgcctgggctgtagctattataaaccggcaggagattggtggacctcgctcttataccatcgccgttgcttccctgggtaaaggagtggcctgtaatcctgcctgcttcatcacacagctcctccctgtgaaaaggaagctagggttctatgaagctacttcaaggttaagaagtcacataaatcccacaggcactgttttgcttcagctagaaaatacaatgcagatgtcattaaaagacttactt

SEQ ID NO: 470 - protein, 417 aa, Artificial Sequence
  variant of human alpha-galactosidase A
MEWSWVFLFFLSVTTGVHSLDNGLARTPPMGWLHWERFMCNLDCQEEPDSCISEKLFMEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAGPLFMSNDLRHISPQAKALLQDKDVIAINQDPLGKQGYQLRKGDNFEVWERPLSGLAWAVAIINRQEIGGPRSYTIAVASLGKGVACNPACFITQLLPVKRKLGFYEATSRLRSHINPTGTVLLQLENTMQMSLKDLL

SEQ ID NO: 471 - DNA, 1251 bp, Artificial Sequence
  variant of human alpha-galactosidase A
atggaatggagctgggtctttctcttcttcctgtcagtaacgactggtgtccactccctggacaatggattggcaaggacgcctccaatgggctggctgcactgggagcgcttcatgtgcaaccttgactgccaggaagagccagattcctgcatcagtgagaagctcttcatggagatggcagagcggatggtcactgaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaagagtataaagagtatcttggactggacatctttcaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 472 - protein, 417 aa, Artificial Sequence
  variant of human alpha-galactosidase A
MEWSWVFLFFLSVTTGVHSLDNGLARTPPMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 473 - DNA, 1194 bp, Artificial Sequence
  variant of human alpha-galactosidase A
ctggacaatggattggcaaggacgcctccaatgggctggctgcactgggagcgcttcatgtgcaaccttgactgccaggaagagccagattcctgcatcagtgagaagctcttcatggagatggcagagcggatggtctctgaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaagagtataaagagtatcttggactggacatctttcaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcgatgcctgggctgtagctattataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 474 - protein, 398 aa, Artificial Sequence
  variant of human alpha-galactosidase A
LDNGLARTPPMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGDAWAVAIINRQEIGGPRSYTIAVASLGKGVACNPACFITQLLPVKRKLGFYEWTSRLRSHINPTGTVLLQLENTMQMSLKDLL

SEQ ID NO: 475 - DNA, 1194 bp, Artificial Sequence
  variant of human alpha-galactosidase A
ctggacaatggattggcaaggacgcctccaatgggctggctgcactgggagcgcttcatgtgcaaccttgactgccaggaagagccagattcctgcatcagtgagaagctcttcgaggagatggcagagcggatggtctctgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaagagtataaagagtatcttggactggacatctttcaaccaggagagaattgttgatgttgctggaccagggggttggaatgacccagatatgttagtgattggcaactttggcctcagctggaaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcctcgcctgggctgtagctattataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 476 - protein, 398 aa, Artificial Sequence
  variant of human alpha-galactosidase A
LDNGLARTPPMGWLHWERFMCNLDCQEEPDSCISEKLFEEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAIINRQEIGGPRSYTIAVASLGKGVACNPACFITQLLPVKRKLGFYEWTSRLRSHINPTGTVLLQLENTMQMSLKDLL

SEQ ID NO: 477 - DNA, 1194 bp, Artificial Sequence
  variant of human alpha-galactosidase A
ctggacaatggattggcaaggacgcctccaatgggctggctgcactgggagcgcttcatgtgcaaccttgactgccaggaagagccagattcctgcatcagtgagaagctcttcgaggagatggcagagctgatggtctctgaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctgggccagtataaagagtatcttggactggacatctaggaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgagccatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgccgttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 478 - protein, 398 aa, Artificial Sequence
  variant of human alpha-galactosidase A
LDNGLARTPPMGWLHWERFMCNLDCQEEPDSCISEKLFEEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWNQQVTQMALWAIMAAPLFMSNDLRAISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 479 - DNA, 1251 bp, Artificial Sequence
  variant of human alpha-galactosidase A
atggaatggagctgggtctttctcttcttcctgtcagtaacgactggtgtccactccctggacaatggattggcaaggacgcctccaatgggctggctgcactgggagcgcttcatgtgcaaccttgactgccaggaagagccagattcctgcatcagtgagaagctcttcgaggagatggcagagctgatggtctctgaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatctttcaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 480 - protein, 417 aa, Artificial Sequence
  variant of human alpha-galactosidase A
MEWSWVFLFFLSVTTGVHSLDNGLARTPPMGWLHWERFMCNLDCQEEPDSCISEKLFEEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 481 - DNA, 1194 bp, Artificial Sequence
  variant of human alpha-galactosidase A
ctggacaatggattggcaaggacgcctccaatgggctggctgcactgggagcgcttcatgtgcaaccttgactgccaggaagagccagattcctgcatcagtgagaagctcttcgaggagatggcagagctgatggtctctgaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaagagtataaagagtatcttggactggacatcttttaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgagccatcagccctcaagccaaagctctccttcaggataaggacgtaattgccatcaatcaggaccccttgggcaagcaagggtaccagcttagacagggagacaactttgaagtgtgggaacgacctctctcaggcgatgcctgggctgtagctatgataaaccggcaggagattggtggacctcgctcttataccatcgccgttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 482 - protein, 398 aa, Artificial Sequence
  variant of human alpha-galactosidase A
LDNGLARTPPMGWLHWERFMCNLDCQEEPDSCISEKLFEEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRAISPQAKALLQDKDVIAINQDPLGKQGYQLRQGDNFEVWERPLSGDAWAVAMINRQEIGGPRSYTIAVASLGKGVACNPACFITQLLPVKRKLGFYEWTSRLRSHINPTGTVLLQLENTMQMSLKDLL

SEQ ID NO: 483 - DNA, 1194 bp, Artificial Sequence
  variant of human alpha-galactosidase A
ctggacaatggattggcaaggacgcctccaatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagaaagggagacaactttgaagtgtgggaacgacctctctcaggcttagcctgggctgtagctatgataaaccggcaggagattggtggacctcgctcttataccatcgccgttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 484 - protein, 398 aa, Artificial Sequence
  variant of human alpha-galactosidase A
LDNGLARTPPMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 485 - DNA, 1194 bp, Artificial Sequence
  variant of human alpha-galactosidase A
ctggacaatggattggcaaggacgcctccaatgggctggctgcactgggagcgcttcatgtgcaaccttgactgccaggaagagccagattcctgcatcagtgagaagctcttcatggagatggcagagctcatggtctctgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagaaagggagacaactttgaagtgtgggaacgacctctctcaggcgatgcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 486 - protein, 398 aa, Artificial Sequence
  variant of human alpha-galactosidase A
LDNGLARTPPMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGDAWAVAMINRQEIGGPRSYTIAVASLGKGVACNPACFITQLLPVKRKLGFYEWTSRLRSHINPTGTVLLQLENTMQMSLKDLL

SEQ ID NO: 487 - DNA, 1194 bp, Artificial Sequence
  variant of human alpha-galactosidase A
ctggacaatggattggcaaggacgcctccaatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagaaagggagacaactttgaagtgtgggaacgacctctctcaggcctcgcctgggctgtagctattataaaccggcaggagattggtggacctcgctcttataccatccccgttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 488 - protein, 398 aa, Artificial Sequence
  variant of human alpha-galactosidase A
LDNGLARTPPMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAIINRQEIGGPRSYTIPVASLGKGVACNPACFITQLLPVKRKLGFYEWTSRLRSHINPTGTVLLQLENTMQMSLKDLL

SEQ ID NO: 489 - DNA, 1194 bp, Artificial Sequence
  variant of human alpha-galactosidase A
ctggacaatggattggcaaggacgcctccaatgggctggctgcactgggagcgcttcatgtgcaaccttgactgccaggaagagccagattcctgcatcagtgagaagctcttcatggagatggcagagctgatggtcactgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaagagtataaagagtatcttggactggacatctaggaaccaggagagaattgttgatgttgctggaccagggggttggaatgacccagatatgttagtgattggcaactttggcctcagctggaaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcctcgcctgggctgtagctattataaaccggcaggagattggtggacctcgctcttataccatcgccgttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 490 - protein, 398 aa, Artificial Sequence
  variant of human alpha-galactosidase A
LDNGLARTPPMGWLHWERFMCNLDCQEEPDSCISEKLFMEMAELMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAIINRQEIGGPRSYTIAVASLGKGVACNPACFITQLLPVKRKLGFYEWTSRLRSHINPTGTVLLQLENTMQMSLKDLL

SEQ ID NO: 491 - DNA, 1251 bp, Artificial Sequence
  variant of human alpha-galactosidase A
atggaatggagctgggtctttctcttcttcctgtcagtaacgactggtgtccactccctggacaatggattggcaaggacgcctccaatgggctggctgcactgggagcgcttcatgtgcaaccttgactgccaggaagagccagattcctgcatcagtgagaagctcttcatggagatggcagagctcatggtcactgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatctaggaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcgatgcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagacctcattaaaagacttactt

SEQ ID NO: 492 - protein, 417 aa, Artificial Sequence
  variant of human alpha-galactosidase A
MEWSWVFLFFLSVTTGVHSLDNGLARTPPMGWLHWERFMCNLDCQEEPDSCISEKLFMEMAELMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGDAWAVAMINRQEIGGPRSYTIAVASLGKGVACNPACFITQLLPVKRKLGFYEWTSRLRSHINPTGTVLLQLENTMQTSLKDLL

SEQ ID NO: 493 - DNA, 1251 bp, Artificial Sequence
  variant of human alpha-galactosidase A
atggaatggagctgggtctttctcttcttcctgtcagtaacgactggtgtccactccctggacaatggattggcaaggacgcctccaatgggctggctgcactgggagcgcttcatgtgcaaccttgactgccaggaagagccagattcctgcatcagtgagaagctcttcatggagatggcagagctgatggtcactgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgagccatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 494 - protein, 417 aa, Artificial Sequence
  variant of human alpha-galactosidase A
MEWSWVFLFFLSVTTGVHSLDNGLARTPPMGWLHWERFMCNLDCQEEPDSCISEKLFMEMAELMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRAISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 495 - DNA, 1251 bp, Artificial Sequence
  variant of human alpha-galactosidase A
atggaatggagctgggtctttctcttcttcctgtcagtaacgactggtgtccactccctggacaatggattggcaaggacgcctccaatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaagagtataaagagtatcttggactggacatcttttaaccaggagagaattgttgatgttgctggaccagggggttggaatgacccagatatgttagtgattggcaactttggcctcagctggaaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaagctacttcaaggttaagaagtcacataaatcccacaggcactgttttgcttcagctagaaaatacaatgcagatgtcattaaaagacttactt

SEQ ID NO: 496 - protein, 417 aa, Artificial Sequence
  variant of human alpha-galactosidase A
MEWSWVFLFFLSVTTGVHSLDNGLARTPPMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEATSRLRSHINPTGTVLLQLENTMQMSLKDLL

SEQ ID NO: 497 - DNA, 1194 bp, Artificial Sequence
  variant of human alpha-galactosidase A
ctggacaatggattggcaaggacgcctccaatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaagagtataaagagtatcttggactggacatctttcaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 498 - protein, 398 aa, Artificial Sequence
  variant of human alpha-galactosidase A
LDNGLARTPPMGWLHWERFMCNLDCQEEPDSCISEKLFMEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 499 - DNA, 1194 bp, Artificial Sequence
  variant of human alpha-galactosidase A
ctggacaatggattggcaaggacgcctccaatgggctggctgcactgggagcgcttcatgtgcaaccttgactgccaggaagagccagattcctgcatcagtgagaagctcttcatggagatggcagagctgatggtctctgaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatctaggaaccaggagagaattgttgatgttgctggaccagggggttggaatgacccagatatgttagtgattggcaactttggcctcagctggaatcagcaagtaactcagatggccctctgggctatcatggctggtcctttattcatgtctaatgacctccgacacatcagccctcaagccaaagctctccttcaggataaggacgtaattgccatcaatcaggaccccttgggcaagcaagggtaccagcttagaaagggagacaactttgaagtgtgggaacgacctctctcaggcctcgcctgggctgtagctatgataaaccggcaggagattggtggacctcgctcttataccatccccgttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 500 - protein, 398 aa, Artificial Sequence
  variant of human alpha-galactosidase A
LDNGLARTPPMGWLHWERFMCNLDCQEEPDSCISEKLFMEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWNQQVTQMALWAIMAGPLFMSNDLRHISPQAKALLQDKDVIAINQDPLGKQGYQLRKGDNFEVWERPLSGLAWAVAMINRQEIGGPRSYTIPVASLGKGVACNPACFITQLLPVKRKLGFYEWTSRLRSHINPTGTVLLQLENTMQMSLKDLL

SEQ ID NO: 501 - DNA, 1194 bp, Artificial Sequence
  variant of human alpha-galactosidase A
ctggacaatggattggcaaggacgcctccaatgggctggctgcactgggagcgcttcatgtgcaaccttgactgccaggaagagccagattcctgcatcagtgagaagctcttcatggagatggcagagctgatggtctctgaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctgggccagtataaagagtatcttggactggacatctaggaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 502 - protein, 398 aa, Artificial Sequence
  variant of human alpha-galactosidase A
LDNGLARTPPMGWLHWERFMCNLDCQEEPDSCISEKLFMEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 503 - DNA, 1194 bp, Artificial Sequence
  variant of human alpha-galactosidase A
ctggacaatggattggcaaggacgcctccaatgggctggctgcactgggagcgcttcatgtgcaaccttgactgccaggaagagccagattcctgcatcagtgagaagctcttcatggagatggcagagctgatggtctctgaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctgggccagtataaagagtatcttggactggacatcttttaaccaggagagaattgttgatgttgctggaccagggggttggaatgacccagatatgttagtgattggcaactttggcctcagctgggaccagcaagtaactcagatggccctatgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcgatgcctgggctgtagctattataaaccggcaggagattggtggacctcgctcttataccatcgccgttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagacctcattaaaagacttactt

SEQ ID NO: 504 - protein, 398 aa, Artificial Sequence
  variant of human alpha-galactosidase A
LDNGLARTPPMGWLHWERFMCNLDCQEEPDSCISEKLFMEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGDAWAVAIINRQEIGGPRSYTIAVASLGKGVACNPACFITQLLPVKRKLGFYEWTSRLRSHINPTGTVLLQLENTMQTSLKDLL

SEQ ID NO: 505 - DNA, 1194 bp, Artificial Sequence
  variant of human alpha-galactosidase A
ctggacaatggattggcaaggacgcctccaatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctgggccagtataaagagtatcttggactggacatcttttaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcctcgcctgggctgtagctattataaaccggcaggagattggtggacctcgctcttataccatcgccgttgcttccctgggtaaaggagtggcctgtaatcctgcctgcttcatcacacagctcctccctgtgaaaaggaagctagggttctatgaagctacttcaaggttaagaagtcacataaatcccacaggcactgttttgcttcagctagaaaatacaatgcagatgtcattaaaagacttactt

SEQ ID NO: 506 - protein, 398 aa, Artificial Sequence
  variant of human alpha-galactosidase A
LDNGLARTPPMGWLHWERFMCNLDCQEEPDSCISEKLFMEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAIINRQEIGGPRSYTIAVASLGKGVACNPACFITQLLPVKRKLGFYEATSRLRSHINPTGTVLLQLENTMQMSLKDLL

SEQ ID NO: 507 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcatggagatggcagagctgatggtctctgaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaagctacttcaaggttaagaagtcacataaatcccacaggcactgttttgcttcagctagaaaatacaatgcagatgtcattaaaagacttactt

SEQ ID NO: 508 - protein, 398 aa, Artificial Sequence
  variant of human alpha-galactosidase A
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEATSRLRSHINPTGTVLLQLENTMQMSLKDLL

SEQ ID NO: 509 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcatggagatggcagagctgatggtctctgaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaagagtataaagagtatcttggactggacatctaggaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgagccatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 510 - protein, 398 aa, Artificial Sequence
  variant of human alpha-galactosidase A
LDNGLARTPTMGWLHWERFMCNLDCQEEPDSCISEKLFMEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWNQQVTQMALWAIMAAPLFMSNDLRAISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 511 - DNA, 1194 bp, Artificial Sequence
  variant of human alpha-galactosidase A
ctggacaatggattggcaaggacgcctaccatgggctggctgcactgggagcgcttcatgtgcaaccttgactgccaggaagagccagattcctgcatcagtgagaagctcttcatggagatggcagagctgatggtctctgaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgagccatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatccccgttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 512 - protein, 398 aa, Artificial Sequence
  variant of human alpha-galactosidase A
LDNGLARTPTMGWLHWERFMCNLDCQEEPDSCISEKLFMEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRAISPQAKALLQDKDVIAINQDPLGKQGYQLRQGDNFEVWERPLSGLAWAVAMINRQEIGGPRSYTIPVASLGKGVACNPACFITQLLPVKRKLGFYEWTSRLRSHINPTGTVLLQLENTMQMSLKDLL

SEQ ID NO: 513 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcatggagatggcagagctgatggtctctgaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaagagtataaagagtatcttggactggacatctttcaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcgatgcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 514 - protein, 398 aa, Artificial Sequence
  variant of human alpha-galactosidase A
LDNGLARTPTMGWLHWERFMCNLDCQEEPDSCISEKLFMEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGDAWAVAMINRQEIGGPRSYTIAVASLGKGVACNPACFITQLLPVKRKLGFYEWTSRLRSHINPTGTVLLQLENTMQMSLKDLL

SEQ ID NO: 515 - DNA, 1251 bp, Artificial Sequence
  variant of human alpha-galactosidase A
atggaatggagctgggtctttctcttcttcctgtcagtaacgactggtgtccactccctggacaatggattggcaaggacgcctacaatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaagagtataaagagtatcttggactggacatcttttaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgccgttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 516 - protein, 417 aa, Artificial Sequence
  variant of human alpha-galactosidase A
MEWSWVFLFFLSVTTGVHSLDNGLARTPTMGWLHWERFMCNLDCQEEPDSCISEKLFMEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 517 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcatggagatggcagagctgatggtctctgaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatctttcaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgagccatcagccctcaagccaaagctctccttcaggataaggacgtaattgccatcaatcaggaccccttgggcaagcaagggtaccagcttagacagggagacaactttgaagtgtgggaacgacctctctcaggcctcgcctgggctgtagctattataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 518 - protein, 398 aa, Artificial Sequence
  variant of human alpha-galactosidase A
LDNGLARTPTMGWLHWERFMCNLDCQEEPDSCISEKLFMEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRAISPQAKALLQDKDVIAINQDPLGKQGYQLRQGDNFEVWERPLSGLAWAVAIINRQEIGGPRSYTIAVASLGKGVACNPACFITQLLPVKRKLGFYEWTSRLRSHINPTGTVLLQLENTMQMSLKDLL

SEQ ID NO: 519 - DNA, 1251 bp, Artificial Sequence
  variant of human alpha-galactosidase A
atggaatggagctgggtctttctcttcttcctgtcagtaacgactggtgtccactccctggacaatggattggcaaggacgcctacaatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctgggaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagaaagggagacaactttgaagtgtgggaacgacctctctcaggcttagcctgggctgtagctattataaaccggcaggagattggtggacctcgctcttataccatccccgttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 520 - protein, 417 aa, Artificial Sequence
  variant of human alpha-galactosidase A
MEWSWVFLFFLSVTTGVHSLDNGLARTPTMGWLHWERFMCNLDCQEEPDSCISEKLFMEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAIINRQEIGGPRSYTIPVASLGKGVACNPACFITQLLPVKRKLGFYEWTSRLRSHINPTGTVLLQLENTMQMSLKDLL

SEQ ID NO: 521 - DNA, 1194 bp, Artificial Sequence
  variant of human alpha-galactosidase A
ctggacaatggattggcaaggacgcctacaatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaatcatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatctttcaaccaggagagaattgttgatgttgctggaccagggggttggaatgacccagatatgttagtgattggcaactttggcctcagctggaaccagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagaaagggagacaactttgaagtgtgggaacgacctctctcaggcctcgcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 522 - protein, 398 aa, Artificial Sequence
  variant of human alpha-galactosidase A
LDNGLARTPTMGWLHWERFMCNLDCQEEPDSCISEKLFMEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 523 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttatggaaatggccgaactgatggtgtccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccattattaatcggcaagagatcggaggtccacgctcctatacaattgctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 524 - protein, 398 aa, Artificial Sequence
  variant of human alpha-galactosidase A
LDNGLARTPTMGWLHWERFMCNLDCQEEPDSCISEKLFMEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIAVASLGKGVACNPACFITQLLPVKRKLGFYEATSRLRSHINPTGTVLLQLENTMQTSLKDLL

SEQ ID NO: 525 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaactgatggtgaccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgcgctatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 526 - protein, 398 aa, Artificial Sequence
  variant of human alpha-galactosidase A
LDNGLARTPTMGWLHWERFMCNLDCQEEPDSCISEKLFEEMAELMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 527 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttgaagaaatggccgaactgatggtgtccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggccctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacctcactgaaggacctcctg

SEQ ID NO: 528 - protein, 398 aa, Artificial Sequence
  variant of human alpha-galactosidase A
LDNGLARTPPMGWLHWERFMCNLDCQEEPDSCISEKLFEEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 529 - DNA, 1194 bp, Artificial Sequence
  variant of human alpha-galactosidase A
ctggataatggattggctagaacacctcccatggggtggcttcactgggagaggttcatgtgcaacctggactgtcaggaagaaccagacagctgcatctccgagaagctctttgaggaaatggccgaacgaatggtgactgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatggaagtccataaagagcatcttggactggaccagttttaatcaggagcgaattgtggatgtcgcaggccctggaggatggaacgatccagacatgctggtgatcggcaattttggcctctcttgggaccagcaggttacccaaatggctctgtgggcaattatggccggccctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 530 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 531 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttatggaaatggccgaacggatggtgtccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggatcagcaggttacccaaatggctctgtgggcaattatggccggccctcttttcatgagcaacgatctgcgcgctatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagatgtcactgaaggacctcctg

SEQ ID NO: 532 - protein, 398 aa, Artificial Sequence
  variant of human alpha-galactosidase A
LDNGLARTPPMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQMSLKDLL

SEQ ID NO: 533 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttatggaaatggccgaacggatggtgaccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgatgggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcaaaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggccctcttttcatgagcaacgatctgcgccatatctcaccacaggcaaaggccctgctccaagacaaagatgtgatagccatcaatcaggacccgttgggaaagcagggctaccagctgagaaaaggcgacaactttgaggtctgggaaaggcctttgagtggactcgcgtgggctgtggccatgattaatcggcaagagatcggaggtccacgctcctatacaattcctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagacctcactgaaggacctcctg

SEQ ID NO: 534 - protein, 398 aa, Artificial Sequence
  variant of human alpha-galactosidase A
LDNGLARTPTMGWLHWERFMCNLDCQEEPDSCISEKLFMEMAERMVTEGWKDAGYEYLCIDDCWMAPQRDSEGRLQADPQRFPHGIRQLANYVHSKGLKLGIYADVGNKTCAGFPGSFGYYDIDAQTFADGGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRHISPQAKALLQDKDVIAINQDPLGKQGYQLRKGDNFEVWERPLSGLAWAVAMINRQEIGGPRSYTIPVASLGKGVACNPACFITQLLPVKRKLGFYEATSRLRSHINPTGTVLLQLENTMQTSLKDLL

SEQ ID NO: 535 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttatggaaatggccgaacggatggtgtccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagttttaatcaggagcgaattgtggatgtcgcaggccctggaggatggaacgatccagacatgctggtgatcggcaattttggcctctcttggaatcagcaggttacccaaatggctctgtgggcaattatggccggccctcttttcatgagcaacgatctgcgcgcgatctcaccacaggcaaaggccctgctccaagacaaagatgtgatagccatcaatcaggacccgttgggaaagcagggctaccagctgagaaagggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaatggaccagcaggctccgatcccacatcaaccctacaggaaccgtcctcttgcagctggagaatacgatgcagacttcactgaaggacctcctg

SEQ ID NO: 536 - protein, 398 aa, Artificial Sequence
  variant of human alpha-galactosidase A
LDNGLARTPPMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSFNQERIVDVAGPGGWNDPDMLVIGNFGLSWNQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEWTSRLRSHINPTGTVLLQLENTMQTSLKDLL

SEQ ID NO: 537 - DNA, 1194 bp, Artificial Sequence
  variant of human alpha-galactosidase A
ctggataatggattggctagaacacctcccatggggtggcttcactgggagaggttcatgtgcaacctggactgtcaggaagaaccagacagctgcatctccgagaagctctttgaggaaatggccgaacggatggtgaccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttggaatcagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagaaagggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagacctcactgaaggacctcctg

SEQ ID NO: 538 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWNQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 539 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttgaggaaatggccgaacgaatggtgactgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagttttaatcaggagcgaattgtggatgtcgcaggccctggaggatggaacgatccagacatgctggtgatcggcaattttggcctctcttgggaccagcaggttacccaaatggctctgtgggcaattatggccggccctcttttcatgagcaacgatctgcgcgcgatctcaccacaggcaaaggccctgctccaagacaaagatgtgatagccatcaatcaggacccgttgggaaagcagggctaccagctgagaaagggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagacttcactgaaggacctcctg

SEQ ID NO: 540 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSFNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 541 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaacggatggtgactgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatggaagtccataaagagcatcttggactggaccagtcggaatcaggagcgaattgtggatgtcgcaggccctggaggatggaacgatccagacatgctggtgatcggcaattttggcctctcttgggatcagcaggttacccaaatggctctgtgggcaattatggccggtcctcttttcatgagcaacgatctgcgcgctatctcaccacaggcaaaggccctgctccaagacaaagatgtgatagccatcaatcaggacccgttgggaaagcagggctaccagctgagaaagggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagacctcactgaaggacctcctg

SEQ ID NO: 542 - protein, 398 aa, Artificial Sequence
  variant of human alpha-galactosidase A
LDNGLARTPTMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 543 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaacgaatggtgactgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggatcagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggactcgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagatgtcactgaaggacctcctg

SEQ ID NO: 544 - protein, 398 aa, Artificial Sequence
  variant of human alpha-galactosidase A
LDNGLARTPTMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGLAWAVAIINRQEIGGPRSYTIPVASLGKGVACNPACFITQLLPVKRKLGFYEATSRLRSHINPTGTVLLQLENTMQMSLKDLL

SEQ ID NO: 545 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttatggaaatggccgaactgatggtgaccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccgcccctcttttcatgagcaacgatctgcgcgctatctcaccacaggcaaaggccctgctccaagacaaagatgtgatagccatcaatcaggacccgttgggaaagcagggctaccagctgagaaaaggcgacaactttgaggtctgggaaaggcctttgagtggactcgcgtgggctgtggccatgattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 546 - protein, 398 aa, Artificial Sequence
  variant of human alpha-galactosidase A
LDNGLARTPTMGWLHWERFMCNLDCQEEPDSCISEKLFMEMAELMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGLAWAVAMINRQEIGGPRSYTIPVASLGKGVACNPACFITQLLPVKRKLGFYEATSRLRSHINPTGTVLLQLENTMQTSLKDLL

SEQ ID NO: 547 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttatggaaatggccgaactgatggtgaccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggccctcttttcatgagcaacgatctgcgcgctatctcaccacaggcaaaggccctgctccaagacaaagatgtgatagccatcaatcaggacccgttgggaaagcagggctaccagctgagacagggcgacaactttgaggtctgggaaaggcctttgagtggagatgcgtgggctgtggccatgattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacctcactgaaggacctcctg

SEQ ID NO: 548 - protein, 398 aa, Artificial Sequence
  variant of human alpha-galactosidase A
LDNGLARTPTMGWLHWERFMCNLDCQEEPDSCISEKLFMEMAELMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRQGDNFEVWERPLSGDAWAVAMINRQEIGGPRSYTIPVASLGKGVACNPACFITQLLPVKRKLGFYEATSRLRSHINPTGTVLLQLENTMQTSLKDLL

SEQ ID NO: 549 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttatggaaatggccgaactgatggtgaccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagttttaatcaggagcgaattgtggatgtcgcaggccctggaggatggaacgatccagacatgctggtgatcggcaattttggcctctcttgggaccagcaggttacccaaatggctctgtgggcaattatggccggccctcttttcatgagcaacgatctgcgcgctatctcaccacaggcaaaggccctgctccaagacaaagatgtgatagccatcaatcaggacccgttgggaaagcagggctaccagctgagacagggcgacaactttgaggtctgggaaaggcctttgagtggagatgcgtgggctgtggccatgattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 550 - protein, 398 aa, Artificial Sequence
  variant of human alpha-galactosidase A
LDNGLARTPTMGWLHWERFMCNLDCQEEPDSCISEKLFMEMAELMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSFNQERIVDVAGPGGWNDPDMLVIGNFGLSWDQQVTQMALWAIMAGPLFMSNDLRAISPQAKALLQDKDVIAINQDPLGKQGYQLRQGDNFEVWERPLSGDAWAVAMINRQEIGGPRSYTIPVASLGKGVACNPACFITQLLPVKRKLGFYEATSRLRSHINPTGTVLLQLENTMQTSLKDLL

SEQ ID NO: 551 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttatggaaatggccgaactgatggtgtccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggatcagcaggttacccaaatggctctgtgggcaattatggccggccctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggactcgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 552 - protein, 398 aa, Artificial Sequence
  variant of human alpha-galactosidase A
LDNGLARTPTMGWLHWERFMCNLDCQEEPDSCISEKLFMEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGLAWAVAIINRQEIGGPRSYTIPVASLGKGVACNPACFITQLLPVKRKLGFYEATSRLRSHINPTGTVLLQLENTMQTSLKDLL

SEQ ID NO: 553 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttatggaaatggccgaactgatggtgtccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatggaagtccataaagagcatcttggactggaccagttttaatcaggagcgaattgtggatgtcgcaggccctggaggatggaacgatccagacatgctggtgatcggcaattttggcctctcttgggatcagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 554 - protein, 398 aa, Artificial Sequence
  variant of human alpha-galactosidase A
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 555 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaacgaatggtgactgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagacagggcgacaactttgaggtctgggaaaggcctttgagtggagatgcgtgggctgtggccataattaatcggcaagagatcggaggtccacgctcctatacaattgctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagacctcactgaaggacctcctg

SEQ ID NO: 556 - protein, 398 aa, Artificial Sequence
  variant of human alpha-galactosidase A
LDNGLARTPTMGWLHWERFMCNLDCQEEPDSCISEKLFEEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRQGDNFEVWERPLSGDAWAVAIINRQEIGGPRSYTIAVASLGKGVACNPACFITQLLPVKRKLGFYEATSRLRSHINPTGTVLLQLENTMQTSLKDLL

SEQ ID NO: 557 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaagaaatggccgaactgatggtgaccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagttttaatcaggagcgaattgtggatgtcgcaggccctggaggatggaacgatccagacatgctggtgatcggcaattttggcctctcttggaatcagcaggttacccaaatggctctgtgggcaattatggccggccctcttttcatgagcaacgatctgcgccatatctcaccacaggcaaaggccctgctccaagacaaagatgtgatagccatcaatcaggacccgttgggaaagcagggctaccagctgagacagggcgacaactttgaggtctgggaaaggcctttgagtggactcgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagatgtcactgaaggacctcctg

SEQ ID NO: 558 - protein, 398 aa, Artificial Sequence
  variant of human alpha-galactosidase A
LDNGLARTPTMGWLHWERFMCNLDCQEEPDSCISEKLFEEMAELMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSFNQERIVDVAGPGGWNDPDMLVIGNFGLSWNQQVTQMALWAIMAGPLFMSNDLRHISPQAKALLQDKDVIAINQDPLGKQGYQLRQGDNFEVWERPLSGLAWAVAIINRQEIGGPRSYTIPVASLGKGVACNPACFITQLLPVKRKLGFYEATSRLRSHINPTGTVLLQLENTMQMSLKDLL

SEQ ID NO: 559 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaactgatggtgtccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggatcagcaggttacccaaatggctctgtgggcaattatggccggtcctcttttcatgagcaacgatctgcgccatatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccatgattaatcggcaagagatcggaggtccacgctcctatacaattcctgtagcatctcttggcaagggcgttgcctgtaacccagcttgcttcatcactcagcttctgccggtgaagagaaaactgggtttctacgaatggaccagcaggctccgatcccacatcaaccctacaggaaccgtcctcttgcagctggagaatacgatgcagacttcactgaaggacctcctg

SEQ ID NO: 560 - protein, 398 aa, Artificial Sequence
  variant of human alpha-galactosidase A
LDNGLARTPTMGWLHWERFMCNLDCQEEPDSCISEKLFEEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRHISPQAKALLQDKDVIAINQDPLGKQGYQLRKGDNFEVWERPLSGDAWAVAMINRQEIGGPRSYTIPVASLGKGVACNPACFITQLLPVKRKLGFYEWTSRLRSHINPTGTVLLQLENTMQTSLKDLL

SEQ ID NO: 561 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaactgatggtgtccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagttttaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgccatatctcaccacaggcaaaggccctgctccaagacaaagatgtgatagccatcaatcaggacccgttgggaaagcagggctaccagctgagaaagggcgacaactttgaggtctgggaaaggcctttgagtggactcgcgtgggctgtggccatgattaatcggcaagagatcggaggtccacgctcctatacaattcctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagacctcactgaaggacctcctg

SEQ ID NO: 562 - protein, 398 aa, Artificial Sequence
  variant of human alpha-galactosidase A
LDNGLARTPTMGWLHWERFMCNLDCQEEPDSCISEKLFEEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSFNQERIVDVAGPGGWNDPDMLVIGNFGLSWDQQVTQMALWAIMAGPLFMSNDLRHISPQAKALLQDKDVIAINQDPLGKQGYQLRKGDNFEVWERPLSGLAWAVAMINRQEIGGPRSYTIPVASLGKGVACNPACFITQLLPVKRKLGFYEATSRLRSHINPTGTVLLQLENTMQTSLKDLL

SEQ ID NO: 563 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttgaagaaatggccgaactgatggtgtccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagaaagggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagatgtcactgaaggacctcctg

SEQ ID NO: 564 - protein, 398 aa, Artificial Sequence
  variant of human alpha-galactosidase A
LDNGLARTPPMGWLHWERFMCNLDCQEEPDSCISEKLFEEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQMSLKDLL

SEQ ID NO: 565 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttgaagaaatggccgaacggatggtgtccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgccatatctcaccacaggcaaaggccctgctccaagacaaagatgtgatagccatcaatcaggacccgttgggaaagcagggctaccagctgagaaagggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 566 - protein, 398 aa, Artificial Sequence
  variant of human alpha-galactosidase A
LDNGLARTPPMGWLHWERFMCNLDCQEEPDSCISEKLFEEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 567 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttgaggaaatggccgaacggatggtgtccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatggaagtccataaagagcatcttggactggaccagttttaatcaggagcgaattgtggatgtcgcaggccctggaggatggaacgatccagacatgctggtgatcggcaattttggcctctcttggaatcagcaggttacccaaatggctctgtgggcaattatggccggccctcttttcatgagcaacgatctgcgcgctatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccataattaatcggcaagagatcggaggtccacgctcctatacaattgctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagacctcactgaaggacctcctg

SEQ ID NO: 568 - protein, 398 aa, Artificial Sequence
  variant of human alpha-galactosidase A
LDNGLARTPPMGWLHWERFMCNLDCQEEPDSCISEKLFEEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAGPLFMSNDLRAISPQAKALLQDKDVIAINQDPLGKQGYQLRKGDNFEVWERPLSGDAWAVAIINRQEIGGPRSYTIAVASLGKGVACNPACFITQLLPVKRKLGFYEATSRLRSHINPTGTVLLQLENTMQTSLKDLL

SEQ ID NO: 569 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttatggaaatggccgaactgatggtgaccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggccctcttttcatgagcaacgatctgcgccatatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccattattaatcggcaagagatcggaggtccacgctcctatacaattgctgtagcatctcttggcaagggcgttgcctgtaacccagcttgcttcatcactcagcttctgccggtgaagagaaaactgggtttctacgaatggaccagcaggctccgatcccacatcaaccctacaggaaccgtcctcttgcagctggagaatacgatgcagatgtcactgaaggacctcctg

SEQ ID NO: 570 - protein, 398 aa, Artificial Sequence
  variant of human alpha-galactosidase A
LDNGLARTPPMGWLHWERFMCNLDCQEEPDSCISEKLFMEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRHISPQAKALLQDKDVIAINQDPLGKQGYQLRKGDNFEVWERPLSGDAWAVAIINRQEIGGPRSYTIAVASLGKGVACNPACFITQLLPVKRKLGFYEWTSRLRSHINPTGTVLLQLENTMQMSLKDLL

SEQ ID NO: 571 - DNA, 1194 bp, Artificial Sequence
  variant of human alpha-galactosidase A
ctggataatggattggctagaacacctcccatggggtggcttcactgggagaggttcatgtgcaacctggactgtcaggaagaaccagacagctgcatctccgagaagctctttatggaaatggccgaactgatggtgtccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatggaagtccataaagagcatcttggactggaccagtcggaatcaggagcgaattgtggatgtcgcaggccctggaggatggaacgatccagacatgctggtgatcggcaattttggcctctcttgggatcagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccataattaatcgccaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagatgtcactgaaggacctcctg

SEQ ID NO: 572 - protein, 398 aa, Artificial Sequence
  variant of human alpha-galactosidase A
LDNGLARTPPMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQMSLKDLL

SEQ ID NO: 573 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttgaggaaatggccgaacgaatggtgactgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatggaagtccataaagagcatcttggactggaccagtcggaatcaggagcgaattgtggatgtcgcaggccctggaggatggaacgatccagacatgctggtgatcggcaattttggcctctcttgggatcagcaggttacccaaatggctctgtgggcaattatggccggccctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccatgattaatcggcaagagatcggaggtccacgctcctatacaattcctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagacttcactgaaggacctcctg

SEQ ID NO: 574 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAMINRQEIGGPRSYTIPVASLGKGVACNPACFITQLLPVKRKLGFYEATSRLRSHINPTGTVLLQLENTMQTSLKDLL

SEQ ID NO: 575 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttatggaaatggccgaactgatggtgaccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggatcagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagacagggcgacaactttgaggtctgggaaaggcctttgagtggagatgcgtgggctgtggccatgattaatcggcaagagatcggaggtccacgctcctatacaattcctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagacttcactgaaggacctcctg

SEQ ID NO: 576 - protein, 398 aa, Artificial Sequence
  variant of human alpha-galactosidase A
LDNGLARTPTMGWLHWERFMCNLDCQEEPDSCISEKLFMEMAELMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRQGDNFEVWERPLSGDAWAVAMINRQEIGGPRSYTIPVASLGKGVACNPACFITQLLPVKRKLGFYEATSRLRSHINPTGTVLLQLENTMQTSLKDLL

SEQ ID NO: 577 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttatggaaatggccgaactgatggtgaccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggccctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagatgtcactgaaggacctcctg

SEQ ID NO: 578 - protein, 398 aa, Artificial Sequence
  variant of human alpha-galactosidase A
LDNGLARTPTMGWLHWERFMCNLDCQEEPDSCISEKLFMEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQMSLKDLL

SEQ ID NO: 579 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttgaggaaatggccgaactgatggtgtccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggatcagcaggttacccaaatggctctgtgggcaattatggccggccctcttttcatgagcaacgatctgcgcgcgatctcaccacaggcaaaggccctgctccaagacaaagatgtgatagccatcaatcaggacccgttgggaaagcagggctaccagctgagaaagggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 580 - protein, 398 aa, Artificial Sequence
  variant of human alpha-galactosidase A
LDNGLARTPPMGWLHWERFMCNLDCQEEPDSCISEKLFEEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 581 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttgaggaaatggccgaacgaatggtgactgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttggaatcagcaggttacccaaatggctctgtgggcaattatggccggccctcttttcatgagcaacgatctgcgcgctatctcaccacaggcaaaggccctgctccaagacaaagatgtgatagccatcaatcaggacccgttgggaaagcagggctaccagctgagaaagggcgacaactttgaggtctgggaaaggcctttgagtggactcgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 582 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWNQQVTQMALWAIMAGPLFMSNDLRAISPQAKALLQDKDVIAINQDPLGKQGYQLRKGDNFEVWERPLSGLAWAVAIINRQEIGGPRSYTIPVASLGKGVACNPACFITQLLPVKRKLGFYEATSRLRSHINPTGTVLLQLENTMQTSLKDLL

SEQ ID NO: 583 - DNA, 1194 bp, Artificial Sequence
  variant of human alpha-galactosidase A
ctggataatggattggctagaacacctcccatggggtggcttcactgggagaggttcatgtgcaacctggactgtcaggaagaaccagacagctgcatctccgagaagctctttgaggaaatggccgaacgaatggtgactgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagaaagggcgacaactttgaggtctgggaaaggcctttgagtggactcgcgtgggctgtggccataattaatcggcaagagatcggaggtccacgctcctatacaattgctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagatgtcactgaaggacctcctg

SEQ ID NO: 584 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGLAWAVAIINRQEIGGPRSYTIAVASLGKGVACNPACFITQLLPVKRKLGFYEATSRLRSHINPTGTVLLQLENTMQMSLKDLL

SEQ ID NO: 585 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttgaggaaatggccgaacgaatggtgactgagggctggaaaaatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagttttaatcaggagcgaattgtggatgtcgcaggccctggaggatggaacgatccagacatgctggtgatcggcaattttggcctctcttgggaccagcaggttacccaaatggctctgtgggcaattatggccggccctcttttcatgagcaacgatctgcgcgctatctcaccacaggcaaaggccctgctccaagacaaagatgtgatagccatcaatcaggacccgttgggaaagcagggctaccagctgagacagggcgacaactttgaggtctgggaaaggcctttgagtggactcgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacctcactgaaggacctcctg

SEQ ID NO: 586 - protein, 398 aa, Artificial Sequence
  variant of human alpha-galactosidase A
LDNGLARTPPMGWLHWERFMCNLDCQEEPDSCISEKLFEEMAERMVTEGWKNAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSFNQERIVDVAGPGGWNDPDMLVIGNFGLSWDQQVTQMALWAIMAGPLFMSNDLRAISPQAKALLQDKDVIAINQDPLGKQGYQLRQGDNFEVWERPLSGLAWAVAIINRQEIGGPRSYTIPVASLGKGVACNPACFITQLLPVKRKLGFYEATSRLRSHINPTGTVLLQLENTMQTSLKDLL

SEQ ID NO: 587 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttgaggaaatggccgaacgaatggtgactgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatggaagtccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgccatatctcaccacaggcaaaggccctgctccaagacaaagatgtgatagccatcaatcaggacccgttgggaaagcagggctaccagctgagaaaaggcgacaactttgaggtctgggaaaggcctttgagtggactcgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 588 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAGPLFMSNDLRHISPQAKALLQDKDVIAINQDPLGKQGYQLRKGDNFEVWERPLSGLAWAVAIINRQEIGGPRSYTIPVASLGKGVACNPACFITQLLPVKRKLGFYEATSRLRSHINPTGTVLLQLENTMQTSLKDLL

SEQ ID NO: 589 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaacgaatggtgactgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccgcccctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccattattaatcggcaagagatcggaggtccacgctcctatacaattgctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagatgtcactgaaggacctcctg

SEQ ID NO: 590 - protein, 398 aa, Artificial Sequence
  variant of human alpha-galactosidase A
LDNGLARTPTMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIAVASLGKGVACNPACFITQLLPVKRKLGFYEATSRLRSHINPTGTVLLQLENTMQMSLKDLL

SEQ ID NO: 591 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagatgctctttgaagaaatggccgaacggatggtgaccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttggaatcagcaggttacccaaatggctctgtgggcaattatggccgcccctcttttcatgagcaacgatctgcgcgctatctcaccacaggcaaaggccctgctccaagacaaagatgtgatagccatcaatcaggacccgttgggaaagcagggctaccagctgagaaaaggcgacaactttgaggtctgggaaaggcctttgagtggactcgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagatgtcactgaaggacctcctg

SEQ ID NO: 592 - protein, 398 aa, Artificial Sequence
  variant of human alpha-galactosidase A
LDNGLARTPTMGWLHWERFMCNLDCQEEPDSCISEMLFEEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWNQQVTQMALWAIMAAPLFMSNDLRAISPQAKALLQDKDVIAINQDPLGKQGYQLRKGDNFEVWERPLSGLAWAVAIINRQEIGGPRSYTIPVASLGKGVACNPACFITQLLPVKRKLGFYEATSRLRSHINPTGTVLLQLENTMQMSLKDLL

SEQ ID NO: 593 - DNA, 1194 bp, Artificial Sequence
  variant of human alpha-galactosidase A
ctggataatggattggctagaacacctcccatggggtggcttcactgggagaggttcatgtgcaacctggactgtcaggaagaaccagacagctgcatctccgagaagctctttgaagaaatggccgaacggatggtgaccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagttttaatcaggagcgaattgtggatgtcgcaggccctggaggatggaacgatccagacatgctggtgatcggcaattttggcctctcttgggaccagcaggttacccaaatggctctgtgggcaattatggccggccctcttttcatgagcaacgatctgcgccatatctcaccacaggcaaaggccctgctccaagacaaagatgtgatagccatcaatcaggacccgttgggaaagcagggctaccagctgagaaagggcgacaactttgaggtctgggaaaggcctttgagtggagatgcgtgggctgtggccattattaatcggcaagagatcggaggtccacgctcctatacaattgctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacctcactgaaggacctcctg

SEQ ID NO: 594 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSFNQERIVDVAGPGGWNDPDMLVIGNFGLSWDQQVTQMALWAIMAGPLFMSNDLRHISPQAKALLQDKDVIAINQDPLGKQGYQLRKGDNFEVWERPLSGDAWAVAIINRQEIGGPRSYTIAVASLGKGVACNPACFITQLLPVKRKLGFYEATSRLRSHINPTGTVLLQLENTMQTSLKDLL

SEQ ID NO: 595 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaacgaatggtgactgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaatggaccagcaggctccgatcccacatcaaccctacaggaaccgtcctcttgcagctggagaatacgatgcagacttcactgaaggacctcctg

SEQ ID NO: 596 - protein, 398 aa, Artificial Sequence
  variant of human alpha-galactosidase A
LDNGLARTPTMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEWTSRLRSHINPTGTVLLQLENTMQTSLKDLL

SEQ ID NO: 597 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttatggaaatggccgaacggatggtgactgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagttttaatcaggagcgaattgtggatgtcgcaggccctggaggatggaacgatccagacatgctggtgatcggcaattttggcctctcttggaatcagcaggttacccaaatggctctgtgggcaattatggccggtcctcttttcatgagcaacgatctgcgccatatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagacctcactgaaggacctcctg

SEQ ID NO: 598 - protein, 398 aa, Artificial Sequence
  variant of human alpha-galactosidase A
LDNGLARTPTMGWLHWERFMCNLDCQEEPDSCISEKLFMEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAGPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 599 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaactgatggtgtccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccgcccctcttttcatgagcaacgatctgcgccatatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 600 - protein, 398 aa, Artificial Sequence
  variant of human alpha-galactosidase A
LDNGLARTPTMGWLHWERFMCNLDCQEEPDSCISEKLFEEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 601 - DNA, 1194 bp, Artificial Sequence
  variant of human alpha-galactosidase A
ctggataatggattggctagaacacctcccatggggtggcttcactgggagaggttcatgtgcaacctggactgtcaggaagaaccagacagctgcatctccgagaagctctttgaggaaatggccgaactgatggtgaccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgcgctatctcaccacaggcaaaggccctgctccaagacaaagatgtgatagccatcaatcaggacccgttgggaaagcagggctaccagctgagaaaaggcgacaactttgaggtctgggaaaggcctttgagtggactcgcgtgggctgtggccatgattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagatgtcactgaaggacctcctg

SEQ ID NO: 602 - protein, 398 aa, Artificial Sequence
  variant of human alpha-galactosidase A
LDNGLARTPPMGWLHWERFMCNLDCQEEPDSCISEKLFEEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGLAWAVAMINRQEIGGPRSYTIPVASLGKGVACNPACFITQLLPVKRKLGFYEATSRLRSHINPTGTVLLQLENTMQMSLKDLL

SEQ ID NO: 603 - DNA, 1194 bp, Artificial Sequence
  variant of human alpha-galactosidase A
ctggataatggattggctagaacacctcccatggggtggcttcactgggagaggttcatgtgcaacctggactgtcaggaagaaccagacagctgcatctccgagaagctctttatggaaatggccgaactgatggtgtccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatggaagtccataaagagcatcttggactggaccagtcggaatcaggagcgaattgtggatgtcgcaggccctggaggatggaacgatccagacatgctggtgatcggcaattttggcctctcttgggatcagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagaaagggcgacaactttgaggtctgggaaaggcctttgagtggagatgcgtgggctgtggccattattaatcggcaagagatcggaggtccacgctcctatacaattgctgtagcatctcttggcaagggcgttgcctgtaacccagcttgcttcatcactcagcttctgccggtgaagagaaaactgggtttctacgaatggaccagcaggctccgatcccacatcaaccctacaggaaccgtcctcttgcagctggagaatacgatgcagatgtcactgaaggacctcctg

SEQ ID NO: 604 - protein, 398 aa, Artificial Sequence
  variant of human alpha-galactosidase A
LDNGLARTPPMGWLHWERFMCNLDCQEEPDSCISEKLFMEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIAVASLGKGVACNPACFITQLLPVKRKLGFYEWTSRLRSHINPTGTVLLQLENTMQMSLKDLL

SEQ ID NO: 605 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaactgatggtgaccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatggaagtccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagaaagggcgacaactttgaggtctgggaaaggcctttgagtggactcgcgtgggctgtggccatgattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 606 - protein, 398 aa, Artificial Sequence
  variant of human alpha-galactosidase A
LDNGLARTPTMGWLHWERFMCNLDCQEEPDSCISEKLFEEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGLAWAVAMINRQEIGGPRSYTIPVASLGKGVACNPACFITQLLPVKRKLGFYEATSRLRSHINPTGTVLLQLENTMQTSLKDLL

SEQ ID NO: 607 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttatggaaatggccgaactgatggtgaccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggccctcttttcatgagcaacgatctgcgccatatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 608 - protein, 398 aa, Artificial Sequence
  variant of human alpha-galactosidase A
LDNGLARTPPMGWLHWERFMCNLDCQEEPDSCISEKLFMEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 609 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttatggaaatggccgaacggatggtgtccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttggaatcagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 610 - protein, 398 aa, Artificial Sequence
  variant of human alpha-galactosidase A
LDNGLARTPPMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWNQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 611 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaacggatggtgaccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatggaagtccataaagagcatcttggactggaccagtcggaatcaggagcgaattgtggatgtcgcaggccctggaggatggaacgatccagacatgctggtgatcggcaattttggcctctcttggaatcagcaggttacccaaatggctctgtgggcaattatggccgcccctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 612 - protein, 398 aa, Artificial Sequence
  variant of human alpha-galactosidase A
LDNGLARTPTMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWKSIKSILDWTSRNQERIVDVAGPGGWNDPDMLVIGNFGLSWNQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 613 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttatggaaatggccgaactgatggtgaccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggatcagcaggttacccaaatggctctgtgggcaattatggccggccctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagatgtcactgaaggacctcctg

SEQ ID NO: 614 - protein, 398 aa, Artificial Sequence
  variant of human alpha-galactosidase A
LDNGLARTPTMGWLHWERFMCNLDCQEEPDSCISEKLFMEMAELMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQMSLKDLL

SEQ ID NO: 615 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaactgatggtgaccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggatcagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagacagggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 616 - protein, 398 aa, Artificial Sequence
  variant of human alpha-galactosidase A
LDNGLARTPTMGWLHWERFMCNLDCQEEPDSCISEKLFEEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRQGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 617 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaagaaatggccgaacggatggtgtccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggccctcttttcatgagcaacgatctgcgccatatctcaccacaggcaaaggccctgctccaagacaaagatgtgatagccatcaatcaggacccgttgggaaagcagggctaccagctgagacagggcgacaactttgaggtctgggaaaggcctttgagtggagatgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 618 - protein, 398 aa, Artificial Sequence
  variant of human alpha-galactosidase A
LDNGLARTPTMGWLHWERFMCNLDCQEEPDSCISEKLFEEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRHISPQAKALLQDKDVIAINQDPLGKQGYQLRQGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 619 - DNA, 1194 bp, Artificial Sequence
  variant of human alpha-galactosidase A
ctggataatggattggctagaacacctcccatggggtggcttcactgggagaggttcatgtgcaacctggactgtcaggaagaaccagacagctgcatctccgagaagctctttgaggaaatggccgaactgatggtgtccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggatcagcaggttacccaaatggctctgtgggcaattatggccggccctcttttcatgagcaacgatctgcgccatatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 620 - protein, 398 aa, Artificial Sequence
  variant of human alpha-galactosidase A
LDNGLARTPPMGWLHWERFMCNLDCQEEPDSCISEKLFEEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 621 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttatggaaatggccgaactgatggtgtccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatggaagtccataaagagcatcttggactggaccagtcggaatcaggagcgaattgtggatgtcgcaggccctggaggatggaacgatccagacatgctggtgatcggcaattttggcctctcttggaatcagcaggttacccaaatggctctgtgggcaattatggccgcccctcttttcatgagcaacgatctgcgcgctatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 622 - protein, 398 aa, Artificial Sequence
  variant of human alpha-galactosidase A
LDNGLARTPPMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWKSIKSILDWTSRNQERIVDVAGPGGWNDPDMLVIGNFGLSWNQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 623 - DNA, 1194 bp, Artificial Sequence
  variant of human alpha-galactosidase A
ctggataatggattggctagaacacctcccatggggtggcttcactgggagaggttcatgtgcaacctggactgtcaggaagaaccagacagctgcatctccgagaagctctttatggaaatggccgaactgatggtgtccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatggaagtccataaagagcatcttggactggaccagtcggaatcaggagcgaattgtggatgtcgcaggccctggaggatggaacgatccagacatgctggtgatcggcaattttggcctctcttgggatcagcaggttacccaaatggctctgtgggcaattatggccggccctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagatgtcactgaaggacctcctg

SEQ ID NO: 624 - protein, 398 aa, Artificial Sequence
  variant of human alpha-galactosidase A
LDNGLARTPPMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQMSLKDLL

SEQ ID NO: 625 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttatggaaatggccgaacggatggtgtccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgcgctatctcaccacaggcaaaggccctgctccaagacaaagatgtgatagccatcaatcaggacccgttgggaaagcagggctaccagctgagaaagggcgacaactttgaggtctgggaaaggcctttgagtggagatgcgtgggctgtggccattattaatcggcaagagatcggaggtccacgctcctatacaattgctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagacttcactgaaggacctcctg

SEQ ID NO: 626 - protein, 398 aa, Artificial Sequence
  variant of human alpha-galactosidase A
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIAVASLGKGVACNPACFITQLLPVKRKLGFYEATSRLRSHINPTGTVLLQLENTMQTSLKDLL

SEQ ID NO: 627 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaacggatggtgactgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagttttaatcaggagcgaattgtggatgtcgcaggccctggaggatggaacgatccagacatgctggtgatcggcaattttggcctctcttggaatcagcaggttacccaaatggctctgtgggcaattatggccgcccctcttttcatgagcaacgatctgcgccatatctcaccacaggcaaaggccctgctccaagacaaagatgtgatagccatcaatcaggacccgttgggaaagcagggctaccagctgagaaagggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 628 - protein, 398 aa, Artificial Sequence
  variant of human alpha-galactosidase A
LDNGLARTPTMGWLHWERFMCNLDCQEEPDSCISEKLFEEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 629 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaacggatggtgtccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagaaagggcgacaactttgaggtctgggaaaggcctttgagtggactcgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagacttcactgaaggacctcctg

SEQ ID NO: 630 - protein, 398 aa, Artificial Sequence
  variant of human alpha-galactosidase A
LDNGLARTPTMGWLHWERFMCNLDCQEEPDSCISEKLFEEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGLAWAVAIINRQEIGGPRSYTIPVASLGKGVACNPACFITQLLPVKRKLGFYEATSRLRSHINPTGTVLLQLENTMQTSLKDLL

SEQ ID NO: 631 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaacggatggtgtccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggactcgcgtgggctgtggccatgattaatcggcaagagatcggaggtccacgctcctatacaattcctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagatgtcactgaaggacctcctg

SEQ ID NO: 632 - protein, 398 aa, Artificial Sequence
  variant of human alpha-galactosidase A
LDNGLARTPTMGWLHWERFMCNLDCQEEPDSCISEKLFEEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGLAWAVAMINRQEIGGPRSYTIPVASLGKGVACNPACFITQLLPVKRKLGFYEATSRLRSHINPTGTVLLQLENTMQMSLKDLL

SEQ ID NO: 633 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttgaggaaatggccgaacgaatggtgactgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagttttaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagaaagggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagatgtcactgaaggacctcctg

SEQ ID NO: 634 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSFNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQMSLKDLL

SEQ ID NO: 635 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttatggaaatggccgaacggatggtgactgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagttttaatcaggagcgaattgtggatgtcgcaggccctggaggatggaacgatccagacatgctggtgatcggcaattttggcctctcttgggaccagcaggttacccaaatggctctgtgggcaattatggccgcccctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggactcgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaatggaccagcaggctccgatcccacatcaaccctacaggaaccgtcctcttgcagctggagaatacgatgcagacttcactgaaggacctcctg

SEQ ID NO: 636 - protein, 398 aa, Artificial Sequence
  variant of human alpha-galactosidase A
LDNGLARTPPMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGLAWAVAIINRQEIGGPRSYTIPVASLGKGVACNPACFITQLLPVKRKLGFYEWTSRLRSHINPTGTVLLQLENTMQTSLKDLL

SEQ ID NO: 637 - DNA, 1194 bp, Artificial Sequence
  variant of human alpha-galactosidase A
ctggataatggattggctagaacacctcccatggggtggcttcactgggagaggttcatgtgcaacctggactgtcaggaagaaccagacagctgcatctccgagaagctctttatggaaatggccgaacggatggtgtccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagttttaatcaggagcgaattgtggatgtcgcaggccctggaggatggaacgatccagacatgctggtgatcggcaattttggcctctcttgggaccagcaggttacccaaatggctctgtgggcaattatggccgcccctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagatgtcactgaaggacctcctg

SEQ ID NO: 638 - protein, 398 aa, Artificial Sequence
  variant of human alpha-galactosidase A
LDNGLARTPPMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQMSLKDLL

SEQ ID NO: 639 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttatggaaatggccgaacggatggtgactgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagttttaatcaggagcgaattgtggatgtcgcaggccctggaggatggaacgatccagacatgctggtgatcggcaattttggcctctcttgggaccagcaggttacccaaatggctctgtgggcaattatggccggccctcttttcatgagcaacgatctgcgcgctatctcaccacaggcaaaggccctgctccaagacaaagatgtgatagccatcaatcaggacccgttgggaaagcagggctaccagctgagaaagggcgacaactttgaggtctgggaaaggcctttgagtggactcgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 640 - protein, 398 aa, Artificial Sequence
  variant of human alpha-galactosidase A
LDNGLARTPTMGWLHWERFMCNLDCQEEPDSCISEKLFMEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSFNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGLAWAVAIINRQEIGGPRSYTIPVASLGKGVACNPACFITQLLPVKRKLGFYEATSRLRSHINPTGTVLLQLENTMQTSLKDLL

SEQ ID NO: 641 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttgaggaaatggccgaacgaatggtgactgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggactcgcgtgggctgtggccatgattaatcggcaagagatcggaggtccacgctcctatacaattcctgtagcatctcttggcaagggcgttgcctgtaacccagcttgcttcatcactcagcttctgccggtgaagagaaaactgggtttctacgaatggaccagcaggctccgatcccacatcaaccctacaggaaccgtcctcttgcagctggagaatacgatgcagacttcactgaaggacctcctg

SEQ ID NO: 642 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGLAWAVAMINRQEIGGPRSYTIPVASLGKGVACNPACFITQLLPVKRKLGFYEWTSRLRSHINPTGTVLLQLENTMQTSLKDLL

SEQ ID NO: 643 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttgaagaaatggccgaacggatggtgaccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggactcgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagacctcactgaaggacctcctg

SEQ ID NO: 644 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGLAWAVAIINRQEIGGPRSYTIPVASLGKGVACNPACFITQLLPVKRKLGFYEATSRLRSHINPTGTVLLQLENTMQTSLKDLL

SEQ ID NO: 645 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttgaggaaatggccgaacgaatggtgactgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagttttaatcaggagcgaattgtggatgtcgcaggccctggaggatggaacgatccagacatgctggtgatcggcaattttggcctctcttgggatcagcaggttacccaaatggctctgtgggcaattatggccggtcctcttttcatgagcaacgatctgcgcgctatctcaccacaggcaaaggccctgctccaagacaaagatgtgatagccatcaatcaggacccgttgggaaagcagggctaccagctgagaaaaggcgacaactttgaggtctgggaaaggcctttgagtggactcgcgtgggctgtggccataattaatcggcaagagatcggaggtccacgctcctatacaattgctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagatgtcactgaaggacctcctg

SEQ ID NO: 646 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGLAWAVAIINRQEIGGPRSYTIAVASLGKGVACNPACFITQLLPVKRKLGFYEATSRLRSHINPTGTVLLQLENTMQMSLKDLL

SEQ ID NO: 647 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttgaggaaatggccgaacgaatggtgactgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagttttaatcaggagcgaattgtggatgtcgcaggccctggaggatggaacgatccagacatgctggtgatcggcaattttggcctctcttgggaccagcaggttacccaaatggctctgtgggcaattatggccgcccctcttttcatgagcaacgatctgcgccatatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagatgtcactgaaggacctcctg

SEQ ID NO: 648 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQMSLKDLL

SEQ ID NO: 649 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaacgaatggtgactgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggccctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggactcgcgtgggctgtggccatgattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 650 - protein, 398 aa, Artificial Sequence
  variant of human alpha-galactosidase A
LDNGLARTPTMGWLHWERFMCNLDCQEEPDSCISEKLFEEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGLAWAVAMINRQEIGGPRSYTIPVASLGKGVACNPACFITQLLPVKRKLGFYEATSRLRSHINPTGTVLLQLENTMQTSLKDLL

SEQ ID NO: 651 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaacgaatggtgactgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 652 - protein, 398 aa, Artificial Sequence
  variant of human alpha-galactosidase A
LDNGLARTPTMGWLHWERFMCNLDCQEEPDSCISEKLFEEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 653 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaacggatggtgaccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggatcagcaggttacccaaatggctctgtgggcaattatggccggccctcttttcatgagcaacgatctgcgcgcgatctcaccacaggcaaaggccctgctccaagacaaagatgtgatagccatcaatcaggacccgttgggaaagcagggctaccagctgagaaagggcgacaactttgaggtctgggaaaggcctttgagtggagatgcgtgggctgtggccattattaatcggcaagagatcggaggtccacgctcctatacaattgctgtagcatctcttggcaagggcgttgcctgtaacccagcttgcttcatcactcagcttctgccggtgaagagaaaactgggtttctacgaatggaccagcaggctccgatcccacatcaaccctacaggaaccgtcctcttgcagctggagaatacgatgcagacctcactgaaggacctcctg

SEQ ID NO: 654 - protein, 398 aa, Artificial Sequence
  variant of human alpha-galactosidase A
LDNGLARTPTMGWLHWERFMCNLDCQEEPDSCISEKLFEEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIAVASLGKGVACNPACFITQLLPVKRKLGFYEWTSRLRSHINPTGTVLLQLENTMQTSLKDLL

SEQ ID NO: 655 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaacggatggtgactgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagttttaatcaggagcgaattgtggatgtcgcaggccctggaggatggaacgatccagacatgctggtgatcggcaattttggcctctcttgggatcagcaggttacccaaatggctctgtgggcaattatggccggccctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccatgattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacctcactgaaggacctcctg

SEQ ID NO: 656 - protein, 398 aa, Artificial Sequence
  variant of human alpha-galactosidase A
LDNGLARTPTMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSFNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAMINRQEIGGPRSYTIPVASLGKGVACNPACFITQLLPVKRKLGFYEATSRLRSHINPTGTVLLQLENTMQTSLKDLL

SEQ ID NO: 657 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaacggatggtgtccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggatcagcaggttacccaaatggctctgtgggcaattatggccggtcctcttttcatgagcaacgatctgcgccatatctcaccacaggcaaaggccctgctccaagacaaagatgtgatagccatcaatcaggacccgttgggaaagcagggctaccagctgagaaaaggcgacaactttgaggtctgggaaaggcctttgagtggactcgcgtgggctgtggccataattaatcggcaagagatcggaggtccacgctcctatacaattgctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 658 - protein, 398 aa, Artificial Sequence
  variant of human alpha-galactosidase A
LDNGLARTPTMGWLHWERFMCNLDCQEEPDSCISEKLFEEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRHISPQAKALLQDKDVIAINQDPLGKQGYQLRKGDNFEVWERPLSGLAWAVAIINRQEIGGPRSYTIAVASLGKGVACNPACFITQLLPVKRKLGFYEATSRLRSHINPTGTVLLQLENTMQTSLKDLL

SEQ ID NO: 659 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaacggatggtgtccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgccatatctcaccacaggcaaaggccctgctccaagacaaagatgtgatagccatcaatcaggacccgttgggaaagcagggctaccagctgagaaagggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagacttcactgaaggacctcctg

SEQ ID NO: 660 - protein, 398 aa, Artificial Sequence
  variant of human alpha-galactosidase A
LDNGLARTPTMGWLHWERFMCNLDCQEEPDSCISEKLFEEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 661 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttgaggaaatggccgaacgaatggtgactgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttggaatcagcaggttacccaaatggctctgtgggcaattatggccggtcctcttttcatgagcaacgatctgcgccatatctcaccacaggcaaaggccctgctccaagacaaagatgtgatagccatcaatcaggacccgttgggaaagcagggctaccagctgagaaagggcgacaactttgaggtctgggaaaggcctttgagtggactcgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagacctcactgaaggacctcctg

SEQ ID NO: 662 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWNQQVTQMALWAIMAGPLFMSNDLRHISPQAKALLQDKDVIAINQDPLGKQGYQLRKGDNFEVWERPLSGLAWAVAIINRQEIGGPRSYTIPVASLGKGVACNPACFITQLLPVKRKLGFYEATSRLRSHINPTGTVLLQLENTMQTSLKDLL

SEQ ID NO: 663 - DNA, 1194 bp, Artificial Sequence
  variant of human alpha-galactosidase A
ctggataatggattggctagaacacctcccatggggtggcttcactgggagaggttcatgtgcaacctggactgtcaggaagaaccagacagctgcatctccgagaagctctttgaggaaatggccgaacgaatggtgactgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaaacagggctaccagctgagaaaaggcgacaactttgaggtctgggaaaggcctttgagtggactcgcgtgggctgtggccatgattaatcggcaagagatcggaggtccacgctcctatacaattgctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacctcactgaaggacctcctg

SEQ ID NO: 664 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGLAWAVAMINRQEIGGPRSYTIAVASLGKGVACNPACFITQLLPVKRKLGFYEATSRLRSHINPTGTVLLQLENTMQTSLKDLL

SEQ ID NO: 665 - DNA, 1194 bp, Artificial Sequence
  variant of human alpha-galactosidase A
ctggataatggattggctagaacacctcccatggggtggcttcactgggagaggttcatgtgcaacctggactgtcaggaagaaccagacagctgcatctccgagaagctctttgaggaaatggccgaacggatggtgactgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagttttaatcaggagcgaattgtggatgtcgcaggccctggaggatggaacgatccagacatgctggtgatcggcaattttggcctctcttgggatcagcaggttacccaaatggctctgtgggcaattatggccggccctcttttcatgagcaacgatctgcgcgctatctcaccacaggcaaaggccctgctccaagacaaagatgtgatagccatcaatcaggacccgttgggaaagcagggctaccagctgagaaaaggcgacaactttgaggtctgggaaaggcctttgagtggactcgcgtgggctgtggccatgattaatcggcaagagatcggaggtccacgctcctatacaattgctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 666 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGLAWAVAMINRQEIGGPRSYTIAVASLGKGVACNPACFITQLLPVKRKLGFYEATSRLRSHINPTGTVLLQLENTMQTSLKDLL

SEQ ID NO: 667 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttgaagaaatggccgaactgatggtgtccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttggaatcagcaggttacccaaatggctctgtgggcaattatggccggccctcttttcatgagcaacgatctgcgccatatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagatgtcactgaaggacctcctg

SEQ ID NO: 668 - protein, 398 aa, Artificial Sequence
  variant of human alpha-galactosidase A
LDNGLARTPPMGWLHWERFMCNLDCQEEPDSCISEKLFEEMAELMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWNQQVTQMALWAIMAGPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQMSLKDLL

SEQ ID NO: 669 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttgaggaaatggccgaacggatggtgtccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatggaagtccataaagagcatcttggactggaccagtcggaatcaggagcgaattgtggatgtcgcaggccctggaggatggaacgatccagacatgctggtgatcggcaattttggcctctcttgggatcagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacctcactgaaggacctcctg

SEQ ID NO: 670 - protein, 398 aa, Artificial Sequence
  variant of human alpha-galactosidase A
LDNGLARTPPMGWLHWERFMCNLDCQEEPDSCISEKLFEEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 671 - DNA, 1194 bp, Artificial Sequence
  variant of human alpha-galactosidase A
ctggataatggattggctagaacacctcccatggggtggcttcactgggagaggttcatgtgcaacctggactgtcaggaagaaccagacagctgcatctccgagaagctctttgaagaaatggccgaacggatggtgtccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagttttaatcaggagcgaattgtggatgtcgcaggccctggaggatggaacgatccagacatgctggtgatcggcaattttggcctctcttgggatcagcaggttacccaaatggctctgtgggcaattatggccggccctcttttcatgagcaacgatctgcgccatatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccataattaatcggcaagagatcggaggtccacgctcctatacaattgctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacctcactgaaggacctcctg

SEQ ID NO: 672 - protein, 398 aa, Artificial Sequence
  variant of human alpha-galactosidase A
LDNGLARTPPMGWLHWERFMCNLDCQEEPDSCISEKLFEEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAGPLFMSNDLRHISPQAKALLQDKDVIAINQDPLGKQGYQLRKGDNFEVWERPLSGDAWAVAIINRQEIGGPRSYTIAVASLGKGVACNPACFITQLLPVKRKLGFYEATSRLRSHINPTGTVLLQLENTMQTSLKDLL

SEQ ID NO: 673 - DNA, 1194 bp, Artificial Sequence
  variant of human alpha-galactosidase A
ctggataatggattggctagaacacctcccatggggtggcttcactgggagaggttcatgtgcaacctggactgtcaggaagaaccagacagctgcatctccgagaagctctttgaagaaatggccgaactgatggtgtccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagttttaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgccatatctcaccacaggcaaaggccctgctccaagacaaagatgtgatagccatcaatcaggacccgttgggaaagcagggctaccagctgagaaagggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagacttcactgaaggacctcctg

SEQ ID NO: 674 - protein, 398 aa, Artificial Sequence
  variant of human alpha-galactosidase A
LDNGLARTPPMGWLHWERFMCNLDCQEEPDSCISEKLFEEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSFNQERIVDVAGPGGWNDPDMLVIGNFGLSWDQQVTQMALWAIMAGPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 675 - DNA, 1194 bp, Artificial Sequence
  variant of human alpha-galactosidase A
ctggataatggattggctagaacacctcccatggggtggcttcactgggagaggttcatgtgcaacctggactgtcaggaagaaccagacagctgcatctccgagaagctctttgaggaaatggccgaacgaatggtgactgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccgcccctcttttcatgagcaacgatctgcgccatatctcaccacaggcaaaggccctgctccaagacaaagatgtgatagccatcaatcaggacccgttgggaaagcagggctaccagctgagaaagggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagacttcactgaaggacctcctg

SEQ ID NO: 676 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 677 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttatggaaatggccgaactgatggtgaccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccgcccctcttttcatgagcaacgatctgcgccatatctcaccacaggcaaaggccctgctccaagacaaagatgtgatagccatcaatcaggacccgttgggaaagcagggctaccagctgagaaaaggcgacaactttgaggtctgggaaaggcctttgagtggactcgcgtgggctgtggccatgattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 678 - protein, 398 aa, Artificial Sequence
  variant of human alpha-galactosidase A
LDNGLARTPTMGWLHWERFMCNLDCQEEPDSCISEKLFMEMAELMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAMINRQEIGGPRSYTIPVASLGKGVACNPACFITQLLPVKRKLGFYEATSRLRSHINPTGTVLLQLENTMQTSLKDLL

SEQ ID NO: 679 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaacggatggtgaccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggatcagcaggttacccaaatggctctgtgggcaattatggccgcccctcttttcatgagcaacgatctgcgccatatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagatgtcactgaaggacctcctg

SEQ ID NO: 680 - protein, 398 aa, Artificial Sequence
  variant of human alpha-galactosidase A
LDNGLARTPTMGWLHWERFMCNLDCQEEPDSCISEKLFEEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQMSLKDLL

SEQ ID NO: 681 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttgaggaaatggccgaacggatggtgtccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagttttaatcaggagcgaattgtggatgtcgcaggccctggaggatggaacgatccagacatgctggtgatcggcaattttggcctctcttggaatcagcaggttacccaaatggctctgtgggcaattatggccgcccctcttttcatgagcaacgatctgcgcgctatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 682 - protein, 398 aa, Artificial Sequence
  variant of human alpha-galactosidase A
LDNGLARTPPMGWLHWERFMCNLDCQEEPDSCISEKLFEEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 683 - DNA, 1194 bp, Artificial Sequence
  variant of human alpha-galactosidase A
ctggataatggattggctagaacacctcccatggggtggcttcactgggagaggttcatgtgcaacctggactgtcaggaagaaccagacagctgcatctccgagaagctctttatggaaatggccgaacggatggtgaccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccgcccctcttttcatgagcaacgatctgcgcgcgatctcaccacaggcaaaggccctgctccaagacaaagatgtgatagccatcaatcaggacccgttgggaaagcagggctaccagctgagacagggcgacaactttgaggtctgggaaaggcctttgagtggagatgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 684 - protein, 398 aa, Artificial Sequence
  variant of human alpha-galactosidase A
LDNGLARTPPMGWLHWERFMCNLDCQEEPDSCISEKLFMEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRQGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 685 - DNA, 1194 bp, Artificial Sequence
  variant of human alpha-galactosidase A
ctggataatggattggctagaacacctcccatggggtggcttcactgggagaggttcatgtgcaacctggactgtcaggaagaaccagacagctgcatctccgagaagctctttatggaaatggccgaacggatggtgaccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagttttaatcaggagcgaattgtggatgtcgcaggccctggaggatggaacgatccagacatgctggtgatcggcaattttggcctctcttgggaccagcaggttacccaaatggctctgtgggcaattatggccggccctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagatgtcactgaaggacctcctg

SEQ ID NO: 686 - protein, 398 aa, Artificial Sequence
  variant of human alpha-galactosidase A
LDNGLARTPPMGWLHWERFMCNLDCQEEPDSCISEKLFMEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQMSLKDLL

SEQ ID NO: 687 - DNA, 1194 bp, Artificial Sequence
  variant of human alpha-galactosidase A
ctggataatggattggctagaacacctcccatggggtggcttcactgggagaggttcatgtgcaacctggactgtcaggaagaaccagacagctgcatctccgagaagctctttatggaaatggccgaacggatggtgactgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggccctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccatgattaatcggcaagagatcggaggtccacgctcctatacaattcctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagacttcactgaaggacctcctg

SEQ ID NO: 688 - protein, 398 aa, Artificial Sequence
  variant of human alpha-galactosidase A
LDNGLARTPPMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAMINRQEIGGPRSYTIPVASLGKGVACNPACFITQLLPVKRKLGFYEATSRLRSHINPTGTVLLQLENTMQTSLKDLL

SEQ ID NO: 689 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttatggaaatggccgaactgatggtgactgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttggaatcagcaggttacccaaatggctctgtgggcaattatggccgcccctcttttcatgagcaacgatctgcgcgcgatctcaccacaggcaaaggccctgctccaagacaaagatgtgatagccatcaatcaggacccgttgggaaagcagggctaccagctgagacagggcgacaactttgaggtctgggaaaggcctttgagtggagatgcgtgggctgtggccattattaatcggcaagagatcggaggtccacgctcctatacaattgctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagacttcactgaaggacctcctg

SEQ ID NO: 690 - protein, 398 aa, Artificial Sequence
  variant of human alpha-galactosidase A
LDNGLARTPPMGWLHWERFMCNLDCQEEPDSCISEKLFMEMAELMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWNQQVTQMALWAIMAAPLFMSNDLRAISPQAKALLQDKDVIAINQDPLGKQGYQLRQGDNFEVWERPLSGDAWAVAIINRQEIGGPRSYTIAVASLGKGVACNPACFITQLLPVKRKLGFYEATSRLRSHINPTGTVLLQLENTMQTSLKDLL

SEQ ID NO: 691 - DNA, 1194 bp, Artificial Sequence
  variant of human alpha-galactosidase A
ctggataatggattggctagaacacctcccatggggtggcttcactgggagaggttcatgtgcaacctggactgtcaggaagaaccagacagctgcatctccgagaagctctttatggaaatggccgaacggatggtgaccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggccctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagcaaccagcaggctccgatcccacatcaaccctacaggaaccgtcctcttgcagctggagaatacgatgcagatgtcactgaaggacctcctg

SEQ ID NO: 692 - protein, 398 aa, Artificial Sequence
  variant of human alpha-galactosidase A
LDNGLARTPPMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQMSLKDLL

SEQ ID NO: 693 - DNA, 1194 bp, Artificial Sequence
  variant of human alpha-galactosidase A
ctggataatggattggctagaacacctcccatggggtggcttcactgggagaggttcatgtgcaacctggactgtcaggaagaaccagacagctgcatctccgagaagctctttatggaaatggccgaacggatggtgtccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggactcgcgtgggctgtggccatgattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacctcactgaaggacctcctg

SEQ ID NO: 694 - protein, 398 aa, Artificial Sequence
  variant of human alpha-galactosidase A
LDNGLARTPPMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGLAWAVAMINRQEIGGPRSYTIPVASLGKGVACNPACFITQLLPVKRKLGFYEATSRLRSHINPTGTVLLQLENTMQTSLKDLL

SEQ ID NO: 695 - DNA, 1194 bp, Artificial Sequence
  variant of human alpha-galactosidase A
ctggataatggattggctagaacacctcctatggggtggcttcactgggagaggttcatgtgcaacctggactgtcaggaagaaccagacagctgcatctccgagaagctctttgaggaaatggccgaacgaatggtgactgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggccctcttttcatgagcaacgatctgcgccatatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 696 - protein, 398 aa, Artificial Sequence
  variant of human alpha-galactosidase A
LDNGLARTPPMGWLHWERFMCNLDCQEEPDSCISEKLFEEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 697 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttatggaaatggccgaacggatggtgactgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggaccagcaggttacccaaatggctctgtgggcaattatggccggtcctcttttcatgagcaacgatctgcgcgcgatctcaccacaggcaaaggccctgctccaagacaaagatgtgatagccatcaatcaggacccgttgggaaagcagggctaccagctgagaaagggcgacaactttgaggtctgggaaaggcctttgagtggagatgcgtgggctgtggccattattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 698 - protein, 398 aa, Artificial Sequence
  variant of human alpha-galactosidase A
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 699 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaggaaatggccgaacgaatggtgaccgagggctggaaagatgcaggttacgagtatctgtgtattgacgattgctggatggccccacaacgggattctgagggaagacttcaggctgatccgcagcgcttccctcatggcataaggcagctggcaaaccacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggccaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggatcagcaggttacccaaatggctctgtgggcaattatggccgcccctcttttcatgagcaacgatctgcgcgctatctcaccacaggcaaaggccctgctccaagacaaagatgtgatagccatcaatcaggacccgttgggaaagcagggctaccagctgagaaaaggcgacaactttgaggtctgggaaaggcctttgagtggagatgcgtgggctgtggccataattaatcggcaagagatcggaggtccacgctcctatacaattcctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacctcactgaaggacctcctg

SEQ ID NO: 700 - protein, 398 aa, Artificial Sequence
  variant of human alpha-galactosidase A
LDNGLARTPTMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRKLGFYEATSRLRSHINPTGTVLLQLENTMQTSLKDLL

SEQ ID NO: 701 - DNA, 1194 bp, Artificial Sequence
  variant of human alpha-galactosidase A
ctggataatggattggctagaacacctaccatggggtggcttcactgggagaggttcatgtgcaacctggactgtcaggaagaaccagacagctgcatctccgagaagctctttgaagaaatggccgaacggatggtgaccgagggctggaaagatgcaggttacgagtatctgtgtattgacgattgctggatggccccacaacgggattctgagggaagacttcaggctgatccgcagcgcttccctcatggcataaggcagctggcaaactacgtccacagtaaggggctcaaattgggaatctacgcggacgtgggcaataagacctgtgccggttttccgggatcattcgggtattatgacattgacgcccaaacgtttgctgattggggcgttgacctgctgaaattcgatggttgctactgtgacagcctcgaaaacctggcagacggctacaagcatatgtctctcgccctgaatagaaccggtcggtcaatcgtatattcctgcgagtggcctctttacatgtggccatttcagaaaccgaactacacagaaattcgccagtattgcaatcattggaggaacttcgctgatatcgatgactcatgggcctccataaagagcatcttggactggaccagtcggaatcaggagcgaattgtggatgtcgcaggccctggaggatggaacgatccagacatgctggtgatcggcaattttggcctctcttgggatcagcaggttacccaaatggctctgtgggcaattatggccgcccctcttttcatgagcaacgatctgcgcgcgatctcaccacaggcaaaggccctgctccaagacaaagatgtgatagccatcaatcaggacccgttgggaaagcagggctaccagctgagaaaaggcgacaactttgaggtctgggaaaggcctttgagtggactcgcgtgggctgtggccatgattaatcggcaagagatcggaggtccacgctcctatacaattgctgtagcatctcttggcaagggcgttgcctgtaacccagcttgcttcatcactcagcttctgccggtgaagagaaaactgggtttctacgaagctaccagcaggctccgatcccacatcaaccctacaggaaccgtcctcttgcagctggagaatacgatgcagacttcactgaaggacctcctg

SEQ ID NO: 702 - protein, 398 aa, Artificial Sequence
  variant of human alpha-galactosidase A
LDNGLARTPTMGWLHWERFMCNLDCQEEPDSCISEKLFEEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGLAWAVAMINRQEIGGPRSYTIAVASLGKGVACNPACFITQLLPVKRKLGFYEATSRLRSHINPTGTVLLQLENTMQTSLKDLL

What is claimed is:

1. A recombinant alpha galactosidase A comprising an amino acid sequence that has at least 90% sequence identity to the amino acid sequence of SEQ ID NO: 158, and wherein the amino acid sequence of said recombinant alpha galactosidase A comprises glycine at the position corresponding to residue 333 of SEQ ID NO: 158.

2. The recombinant alpha galactosidase A of claim 1, wherein said recombinant alpha galactosidase A further comprises at least one additional substitution or substitution set at one or more positions 24/202, 39/47, 39/47/217, 39/151, 39/282/337/398, 39/337/343/398, 39/393/398, 47/130, 47/151, 47/343/345/393, 48, 48/68, 48/68/217/391/393, 48/68, 48/217, 48/345/393, 48/393, 59/143, 68, 68/345, 130, 130/158, 130/158/393, 130/345/393, 143, 143/271, 143/387, 151, 151/158/217/343/345/393, 151/206/282/337/343/345/398, 151/282/393, 151/345/393/398, 151/393, 158, 158/393, 202, 206, 206/217, 217, 217/337/345/398, 271, 282/393, 337/343/345/398, 343, 343/345/393/398, 345, 393, or 393/398, wherein the amino acid position(s) correspond to the amino acid sequence of SEQ ID NO: 158.

3. The recombinant alpha galactosidase A of claim 1, wherein said recombinant alpha galactosidase A comprises the amino acid sequence of SEQ ID NO: 240, 276, 288, or 292.

4. The recombinant alpha galactosidase A of claim 1, wherein said recombinant alpha galactosidase A is more thermostable than the alpha galactosidase A of SEQ ID NO: 2.

5. The recombinant alpha galactosidase A of claim 1, wherein said recombinant alpha galactosidase A is more stable at pH 7 than the alpha galactosidase A of SEQ ID NO: 2.

6. The recombinant alpha galactosidase A of claim 1, wherein said recombinant alpha galactosidase A is more stable at pH 4 than the alpha galactosidase A of SEQ ID NO: 2.

7. The recombinant alpha galactosidase A of claim 1, wherein said recombinant alpha galactosidase A is more stable to exposure to serum than the alpha galactosidase A of SEQ ID NO: 2.

8. The recombinant alpha galactosidase A of claim 1, wherein said recombinant alpha galactosidase A is more lysosomally stable than the alpha galactosidase A of SEQ ID NO: 2.

9. The recombinant alpha galactosidase A of claim 1, wherein said recombinant alpha galactosidase A is more readily taken up by cells than the alpha galactosidase A of SEQ ID NO: 2.

10. The recombinant alpha galactosidase A of claim 1, wherein said recombinant alpha galactosidase A depletes more globotriaosylceramide from cells than the alpha galactosidase A of SEQ ID NO: 2.

11. The recombinant alpha galactosidase A of claim 1, wherein said recombinant alpha galactosidase A is purified.

12. The recombinant alpha galactosidase A of claim 1, wherein said recombinant alpha galactosidase A exhibits at least one property selected from:
 i) enhanced catalytic activity as compared to the alpha galactosidase A of SEQ ID NO: 2;
 ii) increased tolerance to pH 7 as compared to the alpha galactosidase A of SEQ ID NO: 2;
 iii) increased tolerance to pH 4 as compared to the alpha galactosidase A of SEQ ID NO: 2;
 iv) increased tolerance to serum as compared to the alpha galactosidase A of SEQ ID NO: 2;
 v) increased uptake into cells as compared to the alpha galactosidase A of SEQ ID NO: 2;
 vi) increased depletion of globotriaosylceramide from cells as compared to the alpha galactosidase A of SEQ ID NO: 2;
 vii) reduced immunogenicity as compared to the alpha galactosidase A of SEQ ID NO: 2;
 or a combination of any of i), ii), iii), iv), v), vi), and/or vii).

13. A composition comprising at least one recombinant alpha galactosidase A of claim 1.

14. A pharmaceutical composition comprising at least one recombinant alpha galactosidase A of claim 1.

15. The pharmaceutical composition of claim 14, further comprising a pharmaceutically acceptable carrier and/or excipient.

16. The pharmaceutical composition of claim 14, wherein said composition is suitable for parenteral injection or infusion to a human.

17. A method for treating the symptoms of Fabry disease in a subject, comprising administering the pharmaceutical composition of claim 14 to a subject having Fabry disease.

18. The method of claim 17, wherein said symptoms of Fabry disease are ameliorated.

19. The method of claim 17, wherein said subject is able to eat a diet that is less restricted in its fat content than diets required by subjects exhibiting the symptoms of Fabry disease.

20. The method of claim 17, wherein said subject is an infant or child.

21. The method of claim 17, wherein said subject is an adult or young adult.

22. The recombinant alpha galactosidase A of claim 1, wherein said recombinant alpha galactosidase A further comprises at least one additional substitution or substitution set 24S/202N, 39V/47D, 39V/47V/217K, 39V/151L, 39V/282N/337R/398A, 39V/337R/343G/398A, 39V/393V/398A, 47V/130E, ATV/I51L, 47V/343D/345Q/393V, 48D, 48D/68E, 48D/217K, 48D/345Q/393V, 48D/393V, 59A/143S, 68E, 68E/345Q, 130E, 130E/158R, 130E/158R/393V, 130E/345Q/393V, 143S/271N, 143S/387N, 151L, 151L/158R/217K/343G/345Q/393V, 151L/206S/282N/337R/343D/345Q/398A, 151L/282N/393V, 151L/345Q/393V/398A, 151L/393V, 158R, 158R/393V, 202N, 2068S, 2068/217K, 217K, 217K/337R/345Q/398A, 271N, 282N/393V, 337R/343G/345Q/398A, 343D, 343D/345Q/393V/398A, 393V, or 393V/398A, wherein the amino acid position(s) correspond to the amino acid sequence of SEQ ID NO: 158.

23. The recombinant alpha galactosidase A of claim 1, wherein said recombinant alpha galactosidase comprises an amino acid sequence that has at least 91%, sequence identity to the amino acid sequence of SEQ ID NO: 158.

24. The recombinant alpha galactosidase A of claim 1, wherein said recombinant alpha galactosidase comprises an amino acid sequence that has at least 95%, sequence identity to the amino acid sequence of SEQ ID NO: 158.

25. The recombinant alpha galactosidase A of claim 1, wherein said recombinant alpha galactosidase comprises an amino acid sequence that has at least 99% sequence identity to the amino acid sequence of SEQ ID NO: 158.

* * * * *